United States Patent 11,464,836 (RNA FOR TREATMENT OR PROPHYLAXIS OF A LIVER DISEASE) - sequence listing, part 2

SEQ ID NO: 1427 - RNA, 3452 nt, Artificial Sequence
  mRNA product Design3 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1428 - RNA, 3413 nt, Artificial Sequence
  mRNA product Design3 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1429 - RNA, 3347 nt, Artificial Sequence
  mRNA product Design3 comprising derived and/or modified sequence from Clostridium histolyticum__BAA34542.1__HsALB(1-18)_ColH(41-1021) (opt13)
gggagagucccgcagucggcguccagcggcucugcuuguucgugugugugucguugcaggccuuauucaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1430 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt13)
gggagagucccgcagucggcguccagcggcucugcuuguucgugugugugucguugcaggccuuauucaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1431 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 1432 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 1433 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 1434 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 1435 - DNA, 62 bp, Artificial Sequence
  5'-UTR of human peroxisomal multifunctional enzyme type 2 lacking the 5' terminal oligopyrimidine tract
gtcccgcagtcggcgtccagcggctctgcttgttcgtgtgtgtgtcgttgcaggccttattc

SEQ ID NO: 1436 - RNA, 62 nt, Artificial Sequence
  5'-UTR of human peroxisomal multifunctional enzyme type 2 lacking the 5' terminal oligopyrimidine tract mRNA
gucccgcagucggcguccagcggcucugcuuguucgugugugugucguugcaggccuuauuc

SEQ ID NO: 1437 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 1438 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 1439 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 1440 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 1441 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 1442 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 1443 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 1444 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 1445 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 1446 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 1447 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 1448 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 1449 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 1450 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 1451 - DNA, 24 bp, Artificial Sequence
  histone stem-loop sequence
caaaggctcttttcagagccacca

SEQ ID NO: 1452 - RNA, 24 nt, Artificial Sequence
  histone stem-loop sequence mRNA
caaaggcucuuuucagagccacca

SEQ ID NO: 1453 - DNA, 13 bp, Artificial Sequence
  Kozak
gccgccaccatgg

SEQ ID NO: 1454 - RNA, 13 nt, Artificial Sequence
  Kozak mRNA
gccgccaccaugg

SEQ ID NO: 1455 - protein, 24 aa, Artificial Sequence
  derived and/or modified protein sequence (wt) from Homo sapiens__AAA59606.1__signal peptide-HLA-A2-SP
MAVMAPRTLVLLLSGALALTQTWA

SEQ ID NO: 1456 - protein, 23 aa, Artificial Sequence
  derived and/or modified protein sequence (wt) from Homo sapiens__AAA61213.1__signal peptide-HsPLAT
MDAMKRGLCCVLLLCGAVFVSPS

SEQ ID NO: 1457 - protein, 21 aa, Artificial Sequence
  derived and/or modified protein sequence (wt) from Homo sapiens__AAA61213.1__signal peptide-HsPLAT
MDAMKRGLCCVLLLCGAVFVS

SEQ ID NO: 1458 - protein, 22 aa, Artificial Sequence
  derived and/or modified protein sequence (wt) from Homo sapiens__AAA61213.1__signal peptide-HsPLAT
MDAMKRGLCCVLLLCGAVFVSP

SEQ ID NO: 1459 - protein, 27 aa, Artificial Sequence
  derived and/or modified protein sequence (wt) from Homo sapiens__NP_000790.2__signal peptide-HsEPO
MGVHECPAWLWLLLSLLSLPLGLPVLG

SEQ ID NO: 1460 - protein, 18 aa, Artificial Sequence
  derived and/or modified protein sequence (wt) from Homo sapiens__AAB59424.1__signal peptide-IgE
MDWTWILFLVAAATRVHS

SEQ ID NO: 1461 - protein, 24 aa, Artificial Sequence
  derived and/or modified protein sequence (wt) from Homo sapiens__NP_055022.2__signal peptide-HsCD5
MPMGSLQPLATLYLLGMLVASCLG

SEQ ID NO: 1462 - protein, 20 aa, Artificial Sequence
  derived and/or modified protein sequence (wt) from Homo sapiens__NP_000577.2__signal peptide-HsIL2
MYRMQLLSCIALSLALVTNS

SEQ ID NO: 1463 - protein, 18 aa, Artificial Sequence
  derived and/or modified protein sequence (wt) from Homo sapiens__NP_001020371.3 __signal peptide-HsCTRB2
MAFLWLLSCWALLGTTFG

SEQ ID NO: 1464 - protein, 19 aa, Artificial Sequence
  derived and/or modified protein sequence (wt) from Homo sapiens__BAC87457.1__signal peptide-immunoglobulin (IgG heavy chain)
MEFGLSWVFLVALFRGVQC

SEQ ID NO: 1465 - protein, 19 aa, Artificial Sequence
  derived and/or modified protein sequence (wt) from Homo sapiens__AAA52897.1__signal peptide-human immunoglobulin heavy chain
MDWTWRVFCLLAVTPGAHP

SEQ ID NO: 1466 - protein, 19 aa, Artificial Sequence
  derived and/or modified protein sequence (wt) from Homo sapiens__AAA59018.1__signal peptide-human immunoglobulin light chain
MAWSPLFLTLITHCAGSWA

SEQ ID NO: 1467 - protein, 17 aa, Artificial Sequence
  derived and/or modified protein sequence (wt) from Gaussia princeps__AAG54095.1__signal peptide-GpLuc
MGVKVLFALICIAVAEA

SEQ ID NO: 1468 - protein, 21 aa, Artificial Sequence
  derived and/or modified protein sequence (wt) from Mus musculus__BAR42292.1__signal peptide-MmIgkappa
METDTLLLWVLLLWVPGSTGD

SEQ ID NO: 1469 - RNA, 72 nt, Artificial Sequence
  derived and/or modified CDS sequence (wt) from Homo sapiens__AAA59606.1__signal peptide-HLA-A2-SP
auggccgucauggcgccccgaacccucguccugcuacucucgggggcucuggcccugacccagaccugggcg

SEQ ID NO: 1470 - RNA, 69 nt, Artificial Sequence
  derived and/or modified CDS sequence (wt) from Homo sapiens__AAA61213.1__signal peptide-HsPLAT
auggaugcaaugaagagagggcucugcugugugcugcugcuguguggagcagucuucguuucgcccagc

SEQ ID NO: 1471 - RNA, 63 nt, Artificial Sequence
  derived and/or modified CDS sequence (wt) from Homo sapiens__AAA61213.1__signal peptide-HsPLAT
auggaugcaaugaagagagggcucugcugugugcugcugcuguguggagcagucuucguuucg

SEQ ID NO: 1472 - RNA, 66 nt, Artificial Sequence
  derived and/or modified CDS sequence (wt) from Homo sapiens__AAA61213.1__signal peptide-HsPLAT
auggaugcaaugaagagagggcucugcugugugcugcugcuguguggagcagucuucguuucgccc

SEQ ID NO: 1473 - RNA, 81 nt, Artificial Sequence
  derived and/or modified CDS sequence (wt) from Homo sapiens__NP_000790.2__signal peptide-HsEPO
augggggugcacgaauguccugccuggcuguggcuucuccugucccugcugucgcucccucugggccucccaguccugggc

SEQ ID NO: 1474 - RNA, 54 nt, Artificial Sequence
  derived and/or modified CDS sequence (wt) from Homo sapiens__AAB59424.1__signal peptide-IgE
auggacuggaccuggauccuguuccucguggccgccgcgacccgcguccacagc

SEQ ID NO: 1475 - RNA, 72 nt, Artificial Sequence
  derived and/or modified CDS sequence (wt) from Homo sapiens__NP_055022.2__signal peptide-HsCD5
augcccauggggucucugcaaccgcuggccaccuuguaccugcuggggaugcuggucgcuuccugccucgga

SEQ ID NO: 1476 - RNA, 60 nt, Artificial Sequence
  derived and/or modified CDS sequence (wt) from Homo sapiens__NP_000577.2__signal peptide-HsIL2
auguacaggaugcaacuccugucuugcauugcacuaagucuugcacuugucacaaacagu

SEQ ID NO: 1477 - RNA, 54 nt, Artificial Sequence
  derived and/or modified CDS sequence (wt) from Homo sapiens__NP_001020371.3 __signal peptide-HsCTRB2
auggcuuuccucuggcuccucuccugcugggcccuccuggguaccaccuucggc

SEQ ID NO: 1478 - RNA, 57 nt, Artificial Sequence
  derived and/or modified CDS sequence (wt) from Homo sapiens__BAC87457.1__signal peptide-immunoglobulin (IgG heavy chain)
auggaguuugggcugagcuggguuuuccucguugcucuuuuuagagguguccagugu

SEQ ID NO: 1479 - RNA, 57 nt, Artificial Sequence
  derived and/or modified CDS sequence (wt) from Homo sapiens__AAA52897.1__signal peptide-human immunoglobulin heavy chain
auggacuggaccuggagggucuucuguuugcuggcuguaacuccaggcgcccacccc

SEQ ID NO: 1480 - RNA, 57 nt, Artificial Sequence
  derived and/or modified CDS sequence (wt) from Homo sapiens__AAA59018.1__signal peptide-human immunoglobulin light chain
auggccugguccccucucuuccucacccucaucacucacugugcaggguccugggcc

SEQ ID NO: 1481 - RNA, 51 nt, Artificial Sequence
  derived and/or modified CDS sequence (wt) from Gaussia princeps__AAG54095.1__signal peptide-GpLuc
augggagucaaaguucuguuugcccugaucugcaucgcuguggccgaggcc

SEQ ID NO: 1482 - RNA, 63 nt, Artificial Sequence
  derived and/or modified CDS sequence (wt) from Mus musculus__BAR42292.1__signal peptide-MmIgkappa
auggagacagacacacuccugcuaugggugcugcugcucuggguuccagguuccacaggugac

SEQ ID NO: 1483 - RNA, 72 nt, Artificial Sequence
  derived and/or modified CDS sequence (opt1) from Homo sapiens__AAA59606.1__signal peptide-HLA-A2-SP
auggccgugauggccccgcggacccugguccuccugcugagcggcgcgcucgcccugacccagacgugggcc

SEQ ID NO: 1484 - RNA, 69 nt, Artificial Sequence
  derived and/or modified CDS sequence (opt1) from Homo sapiens__AAA61213.1__signal peptide-HsPLAT
auggacgccaugaagcgcggccugugcugcgugcuccugcugugcggggccgucuucgugagccccucc

SEQ ID NO: 1485 - RNA, 63 nt, Artificial Sequence
  derived and/or modified CDS sequence (opt1) from Homo sapiens__AAA61213.1__signal peptide-HsPLAT
auggacgccaugaagcgcggccugugcugcgugcuccugcugugcggggccgucuucgugagc

SEQ ID NO: 1486 - RNA, 66 nt, Artificial Sequence
  derived and/or modified CDS sequence (opt1) from Homo sapiens__AAA61213.1__signal peptide-HsPLAT
auggacgccaugaagcgcggccugugcugcgugcuccugcugugcggggccgucuucgugagcccc

SEQ ID NO: 1487 - RNA, 81 nt, Artificial Sequence
  derived and/or modified CDS sequence (opt1) from Homo sapiens__NP_000790.2__signal peptide-HsEPO
augggcgugcacgagugccccgccuggcuguggcuccugcugagccuccugucccugccgcucgggcugcccguccugggc

SEQ ID NO: 1488 - RNA, 54 nt, Artificial Sequence; identical to SEQ ID NO: 1474
  derived and/or modified CDS sequence (opt1) from Homo sapiens__AAB59424.1__signal peptide-IgE

SEQ ID NO: 1489 - RNA, 72 nt, Artificial Sequence
  derived and/or modified CDS sequence (opt1) from Homo sapiens__NP_055022.2__signal peptide-HsCD5
augcccaugggcagccugcagccgcucgccacccuguaccugcucgggaugcugguggccuccugccugggc

SEQ ID NO: 1490 - RNA, 60 nt, Artificial Sequence
  derived and/or modified CDS sequence (opt1) from Homo sapiens__NP_000577.2__signal peptide-HsIL2
auguaccggaugcagcugcucagcugcaucgcccugucgcuggcgcucgugaccaacagc

SEQ ID NO: 1491 - RNA, 54 nt, Artificial Sequence
  derived and/or modified CDS sequence (opt1) from Homo sapiens__NP_001020371.3 __signal peptide-HsCTRB2
auggccuuccuguggcuccugagcugcugggcccugcucggcaccaccuucggg

SEQ ID NO: 1492 - RNA, 57 nt, Artificial Sequence
  derived and/or modified CDS sequence (opt1) from Homo sapiens__BAC87457.1__signal peptide-immunoglobulin (IgG heavy chain)
auggaguucggccugagcuggguguuccucgucgcccuguuccgcggggugcagugc

SEQ ID NO: 1493 - RNA, 57 nt, Artificial Sequence
  derived and/or modified CDS sequence (opt1) from Homo sapiens__AAA52897.1__signal peptide-human immunoglobulin heavy chain
auggacuggaccuggcgcguguucugccugcucgccgucacccccggcgcccacccg

SEQ ID NO: 1494 - RNA, 57 nt, Artificial Sequence
  derived and/or modified CDS sequence (opt1) from Homo sapiens__AAA59018.1__signal peptide-human immunoglobulin light chain
auggccuggagcccccuguuccucacccugaucacccacugcgccggcuccugggcg

SEQ ID NO: 1495 - RNA, 51 nt, Artificial Sequence
  derived and/or modified CDS sequence (opt1) from Gaussia princeps__AAG54095.1__signal peptide-GpLuc
augggcgugaagguccuguucgcccucaucugcaucgccguggcggaggcc

SEQ ID NO: 1496 - RNA, 63 nt, Artificial Sequence
  derived and/or modified CDS sequence (opt1) from Mus musculus__BAR42292.1__signal peptide-MmIgkappa
auggagaccgacacccugcuccugugggugcugcuccuguggguccccggcagcacgggggac

SEQ ID NO: 1497 - RNA, 72 nt, Artificial Sequence
  derived and/or modified CDS sequence (opt2) from Homo sapiens__AAA59606.1__signal peptide-HLA-A2-SP
auggccgucauggccccccgcacccucguccuccuccucuccggcgcccucgcccucacccagaccugggcc

SEQ ID NO: 1498 - RNA, 69 nt, Artificial Sequence
  derived and/or modified CDS sequence (opt2) from Homo sapiens__AAA61213.1__signal peptide-HsPLAT
auggacgccaugaagcgcggccucugcugcguccuccuccucugcggcgccgucuucgucucccccucc

SEQ ID NO: 1499 - RNA, 63 nt, Artificial Sequence
  derived and/or modified CDS sequence (opt2) from Homo sapiens__AAA61213.1__signal peptide-HsPLAT
auggacgccaugaagcgcggccucugcugcguccuccuccucugcggcgccgucuucgucucc

SEQ ID NO: 1500 - RNA, 66 nt, Artificial Sequence
  derived and/or modified CDS sequence (opt2) from Homo sapiens__AAA61213.1__signal peptide-HsPLAT
auggacgccaugaagcgcggccucugcugcguccuccuccucugcggcgccgucuucgucuccccc

SEQ ID NO: 1501 - RNA, 81 nt, Artificial Sequence
  derived and/or modified CDS sequence (opt2) from Homo sapiens__NP_000790.2__signal peptide-HsEPO
augggcguccacgagugccccgccuggcucuggcuccuccucucccuccucucccucccccucggccuccccguccucggc

SEQ ID NO: 1502 - RNA, 54 nt, Artificial Sequence
  derived and/or modified CDS sequence (opt2) from Homo sapiens__AAB59424.1__signal peptide-IgE
auggacuggaccuggauccucuuccucgucgccgccgccacccgcguccacucc

SEQ ID NO: 1503 - RNA, 72 nt, Artificial Sequence
  derived and/or modified CDS sequence (opt2) from Homo sapiens__NP_055022.2__signal peptide-HsCD5
augcccaugggcucccuccagccccucgccacccucuaccuccucggcaugcucgucgccuccugccucggc

SEQ ID NO: 1504 - RNA, 60 nt, Artificial Sequence
  derived and/or modified CDS sequence (opt2) from Homo sapiens__NP_000577.2__signal peptide-HsIL2
auguaccgcaugcagcuccucuccugcaucgcccucucccucgcccucgucaccaacucc

SEQ ID NO: 1505 - RNA, 54 nt, Artificial Sequence
  derived and/or modified CDS sequence (opt2) from Homo sapiens__NP_001020371.3 __signal peptide-HsCTRB2
auggccuuccucuggcuccucuccugcugggcccuccucggcaccaccuucggc

SEQ ID NO: 1506 - RNA, 57 nt, Artificial Sequence
  derived and/or modified CDS sequence (opt2) from Homo sapiens__BAC87457.1__signal peptide-immunoglobulin (IgG heavy chain)
auggaguucggccucuccugggucuuccucgucgcccucuuccgcggcguccagugc

SEQ ID NO: 1507 - RNA, 57 nt, Artificial Sequence
  derived and/or modified CDS sequence (opt2) from Homo sapiens__AAA52897.1__signal peptide-human immunoglobulin heavy chain
auggacuggaccuggcgcgucuucugccuccucgccgucacccccggcgcccacccc

SEQ ID NO: 1508 - RNA, 57 nt, Artificial Sequence
  derived and/or modified CDS sequence (opt2) from Homo sapiens__AAA59018.1__signal peptide-human immunoglobulin light chain
auggccugguccccccucuuccucacccucaucacccacugcgccggcuccugggcc

SEQ ID NO: 1509 - RNA, 51 nt, Artificial Sequence
  derived and/or modified CDS sequence (opt2) from Gaussia princeps__AAG54095.1__signal peptide-GpLuc
augggcgucaagguccucuucgcccucaucugcaucgccgucgccgaggcc

SEQ ID NO: 1510 - RNA, 63 nt, Artificial Sequence
  derived and/or modified CDS sequence (opt2) from Mus musculus__BAR42292.1__signal peptide-MmIgkappa
auggagaccgacacccuccuccucuggguccuccuccucuggguccccggcuccaccggcgac

SEQ ID NO: 1511 - RNA, 72 nt, Artificial Sequence
  derived and/or modified CDS sequence (opt3) from Homo sapiens__AAA59606.1__signal peptide-HLA-A2-SP
auggccgugauggcucccagaacccugguccuccuucugagcggcgcauuggccuuaacacagacuugggcg

SEQ ID NO: 1512 - RNA, 69 nt, Artificial Sequence
  derived and/or modified CDS sequence (opt3) from Homo sapiens__AAA61213.1__signal peptide-HsPLAT
auggacgccaugaagagaggccugugcugugugcuccuucugugcggggcugucuucguuagccccucc

SEQ ID NO: 1513 - RNA, 63 nt, Artificial Sequence
  derived and/or modified CDS sequence (opt3) from Homo sapiens__AAA61213.1__signal peptide-HsPLAT
auggacgccaugaagagaggccugugcugugugcuccuucugugcggggcugucuucguuagc

SEQ ID NO: 1514 - RNA, 66 nt, Artificial Sequence
  derived and/or modified CDS sequence (opt3) from Homo sapiens__AAA61213.1__signal peptide-HsPLAT
auggacgccaugaagagaggccugugcugugugcuccuucugugcggggcugucuucguuagcccc

SEQ ID NO: 1515 - RNA, 81 nt, Artificial Sequence
  derived and/or modified CDS sequence (opt3) from Homo sapiens__NP_000790.2__signal peptide-HsEPO
augggcgugcacgagugccccgccuggcuguggcuccuucugagcuuguuaucccugccucuagggcucccaguccuggga

SEQ ID NO: 1516 - RNA, 54 nt, Artificial Sequence
  derived and/or modified CDS sequence (opt3) from Homo sapiens__AAB59424.1__signal peptide-IgE
auggacuggaccuggauccuguuccucguggccgcugcaacaagaguccacagc

SEQ ID NO: 1517 - RNA, 72 nt, Artificial Sequence
  derived and/or modified CDS sequence (opt3) from Homo sapiens__NP_055022.2__signal peptide-HsCD5
augcccaugggcagccugcagccucucgccacccuuuaccuguuggggauguuaguggcuuccugccuggga

SEQ ID NO: 1518 - RNA, 60 nt, Artificial Sequence
  derived and/or modified CDS sequence (opt3) from Homo sapiens__NP_000577.2__signal peptide-HsIL2
auguacagaaugcagcugcucagcugcaucgcccuuucccuggcuuuggugaccaacucu

SEQ ID NO: 1519 - RNA, 54 nt, Artificial Sequence
  derived and/or modified CDS sequence (opt3) from Homo sapiens__NP_001020371.3 __signal peptide-HsCTRB2
auggccuuccuguggcuccuuagcugcugggcucuguugggcaccacauuuggg

SEQ ID NO: 1520 - RNA, 57 nt, Artificial Sequence
  derived and/or modified CDS sequence (opt3) from Homo sapiens__BAC87457.1__signal peptide-immunoglobulin (IgG heavy chain)
auggaguucggccugagcuggguguuucucgucgcccuuuucagagggguucagugc

SEQ ID NO: 1521 - RNA, 57 nt, Artificial Sequence
  derived and/or modified CDS sequence (opt3) from Homo sapiens__AAA52897.1__signal peptide-human immunoglobulin heavy chain
auggacuggaccuggagaguguucugccugcucgccgucacacccggcgcucacccu

SEQ ID NO: 1522 - RNA, 57 nt, Artificial Sequence
  derived and/or modified CDS sequence (opt3) from Homo sapiens__AAA59018.1__signal peptide-human immunoglobulin light chain
auggccuggagcccccuguuccucacccuuaucacacacugcgcuggcuccugggca

SEQ ID NO: 1523 - RNA, 51 nt, Artificial Sequence
  derived and/or modified CDS sequence (opt3) from Gaussia princeps__AAG54095.1__signal peptide-GpLuc
augggcgugaagguccuguucgcccucaucugcauugcuguugcagaggcc

SEQ ID NO: 1524 - RNA, 63 nt, Artificial Sequence
  derived and/or modified CDS sequence (opt3) from Mus musculus__BAR42292.1__signal peptide-MmIgkappa
auggagaccgacacacugcuccuuugggugcuguuguuauggguccccggcagcacuggggau

SEQ ID NO: 1525 - RNA, 72 nt, Artificial Sequence
  derived and/or modified CDS sequence (opt4) from Homo sapiens__AAA59606.1__signal peptide-HLA-A2-SP
auggccgugauggcccccagaacccuggugcugcugcugagcggcgcccuggcccugacccagaccugggcc

SEQ ID NO: 1526 - RNA, 69 nt, Artificial Sequence
  derived and/or modified CDS sequence (opt4) from Homo sapiens__AAA61213.1__signal peptide-HsPLAT
auggacgccaugaagagaggccugugcugcgugcugcugcugugcggcgccguguucgugagccccagc

SEQ ID NO: 1527 - RNA, 63 nt, Artificial Sequence
  derived and/or modified CDS sequence (opt4) from Homo sapiens__AAA61213.1__signal peptide-HsPLAT
auggacgccaugaagagaggccugugcugcgugcugcugcugugcggcgccguguucgugagc

SEQ ID NO: 1528 - RNA, 66 nt, Artificial Sequence
  derived and/or modified CDS sequence (opt4) from Homo sapiens__AAA61213.1__signal peptide-HsPLAT
auggacgccaugaagagaggccugugcugcgugcugcugcugugcggcgccguguucgugagcccc

SEQ ID NO: 1529 - RNA, 81 nt, Artificial Sequence
  derived and/or modified CDS sequence (opt4) from Homo sapiens__NP_000790.2__signal peptide-HsEPO
augggcgugcacgagugccccgccuggcuguggcugcugcugagccugcugagccugccccugggccugcccgugcugggc

SEQ ID NO: 1530 - RNA, 54 nt, Artificial Sequence
  derived and/or modified CDS sequence (opt4) from Homo sapiens__AAB59424.1__signal peptide-IgE
auggacuggaccuggauccuguuccugguggccgccgccaccagagugcacagc

SEQ ID NO: 1531 - RNA, 72 nt, Artificial Sequence
  derived and/or modified CDS sequence (opt4) from Homo sapiens__NP_055022.2__signal peptide-HsCD5
augcccaugggcagccugcagccccuggccacccuguaccugcugggcaugcugguggccagcugccugggc

SEQ ID NO: 1532 - RNA, 60 nt, Artificial Sequence
  derived and/or modified CDS sequence (opt4) from Homo sapiens__NP_000577.2__signal peptide-HsIL2
auguacagaaugcagcugcugagcugcaucgcccugagccuggcccuggugaccaacagc

SEQ ID NO: 1533 - RNA, 54 nt, Artificial Sequence
  derived and/or modified CDS sequence (opt4) from Homo sapiens__NP_001020371.3 __signal peptide-HsCTRB2
auggccuuccuguggcugcugagcugcugggcccugcugggcaccaccuucggc

SEQ ID NO: 1534 - RNA, 57 nt, Artificial Sequence
  derived and/or modified CDS sequence (opt4) from Homo sapiens__BAC87457.1__signal peptide-immunoglobulin (IgG heavy chain)
auggaguucggccugagcuggguguuccugguggcccuguucagaggcgugcagugc

SEQ ID NO: 1535 - RNA, 57 nt, Artificial Sequence
  derived and/or modified CDS sequence (opt4) from Homo sapiens__AAA52897.1__signal peptide-human immunoglobulin heavy chain
auggacuggaccuggagaguguucugccugcuggccgugacccccggcgcccacccc

SEQ ID NO: 1536 - RNA, 57 nt, Artificial Sequence
  derived and/or modified CDS sequence (opt4) from Homo sapiens__AAA59018.1__signal peptide-human immunoglobulin light chain
auggccuggagcccccuguuccugacccugaucacccacugcgccggcagcugggcc

SEQ ID NO: 1537 - RNA, 51 nt, Artificial Sequence
  derived and/or modified CDS sequence (opt4) from Gaussia princeps__AAG54095.1__signal peptide-GpLuc
augggcgugaaggugcuguucgcccugaucugcaucgccguggccgaggcc

SEQ ID NO: 1538 - RNA, 63 nt, Artificial Sequence
  derived and/or modified CDS sequence (opt4) from Mus musculus__BAR42292.1__signal peptide-MmIgkappa
auggagaccgacacccugcugcugugggugcugcugcugugggugcccggcagcaccggcgac

SEQ ID NO: 1539 - RNA, 72 nt, Artificial Sequence
  derived and/or modified CDS sequence (opt5) from Homo sapiens__AAA59606.1__signal peptide-HLA-A2-SP
auggccgugauggcucccagaacccugguccuccugcuuagcggcgcccuggcgcucacacagacgugggcu

SEQ ID NO: 1540 - RNA, 69 nt, Artificial Sequence
  derived and/or modified CDS sequence (opt5) from Homo sapiens__AAA61213.1__signal peptide-HsPLAT
auggacgccaugaagagaggccugugcugugugcuccugcuuugcggggcugucuucguuagccccucc

SEQ ID NO: 1541 - RNA, 63 nt, Artificial Sequence
  derived and/or modified CDS sequence (opt5) from Homo sapiens__AAA61213.1__signal peptide-HsPLAT
auggacgccaugaagagaggccugugcugugugcuccugcuuugcggggcugucuucguuagc

SEQ ID NO: 1542 - RNA, 66 nt, Artificial Sequence
  derived and/or modified CDS sequence (opt5) from Homo sapiens__AAA61213.1__signal peptide-HsPLAT
auggacgccaugaagagaggccugugcugugugcuccugcuuugcggggcugucuucguuagcccc

SEQ ID NO: 1543 - RNA, 81 nt, Artificial Sequence
  derived and/or modified CDS sequence (opt5) from Homo sapiens__NP_000790.2__signal peptide-HsEPO
augggcgugcacgagugccccgccuggcuguggcuccugcuuagccugcucucccugccucuugggcugccgguccucgga

SEQ ID NO: 1544 - RNA, 54 nt, Artificial Sequence
  derived and/or modified CDS sequence (opt5) from Homo sapiens__AAB59424.1__signal peptide-IgE
auggacuggaccuggauccuguuccucguggccgcugccacaagaguccacagc

SEQ ID NO: 1545 - RNA, 72 nt, Artificial Sequence
  derived and/or modified CDS sequence (opt5) from Homo sapiens__NP_055022.2__signal peptide-HsCD5
augcccaugggcagccugcagccucucgccacccuguaccuucuggggaugcucguggcuuccugccuggga

SEQ ID NO: 1546 - RNA, 60 nt, Artificial Sequence
  derived and/or modified CDS sequence (opt5) from Homo sapiens__NP_000577.2__signal peptide-HsIL2
auguacagaaugcagcugcucagcugcaucgcccugucccuugcucuggugaccaacucu

SEQ ID NO: 1547 - RNA, 54 nt, Artificial Sequence
  derived and/or modified CDS sequence (opt5) from Homo sapiens__NP_001020371.3 __signal peptide-HsCTRB2
auggcuuuccuguggcuccugagcugcugggcccuucugggcaccacauuuggg

SEQ ID NO: 1548 - RNA, 57 nt, Artificial Sequence
  derived and/or modified CDS sequence (opt5) from Homo sapiens__BAC87457.1__signal peptide-immunoglobulin (IgG heavy chain)
auggaguucggccugagcuggguguuucucgucgcccuguucagagggguucagugc

SEQ ID NO: 1549 - RNA, 57 nt, Artificial Sequence; identical to SEQ ID NO: 1521
  derived and/or modified CDS sequence (opt5) from Homo sapiens__AAA52897.1__signal peptide-human immunoglobulin heavy chain

SEQ ID NO: 1550 - RNA, 57 nt, Artificial Sequence
  derived and/or modified CDS sequence (opt5) from Homo sapiens__AAA59018.1__signal peptide-human immunoglobulin light chain
auggccuggagcccccuguuccucacccugaucacacacugcgcuggcuccugggcc

SEQ ID NO: 1551 - RNA, 51 nt, Artificial Sequence
  derived and/or modified CDS sequence (opt5) from Gaussia princeps__AAG54095.1__signal peptide-GpLuc
augggcgugaagguccuguucgcccucaucugcauugcuguugccgaggcg

SEQ ID NO: 1552 - RNA, 63 nt, Artificial Sequence
  derived and/or modified CDS sequence (opt5) from Mus musculus__BAR42292.1__signal peptide-MmIgkappa
auggagaccgacacacugcuccugugggugcuucugcucuggguccccggcagcacgggggau

SEQ ID NO: 1553 - RNA, 72 nt, Artificial Sequence
  derived and/or modified CDS sequence (opt6) from Homo sapiens__AAA59606.1__signal peptide-HLA-A2-SP
auggcaguaauggcaccaagaacauuaguacuacuacuaucaggagcacuagcacuaacacaaacaugggca

SEQ ID NO: 1554 - RNA, 69 nt, Artificial Sequence
  derived and/or modified CDS sequence (opt6) from Homo sapiens__AAA61213.1__signal peptide-HsPLAT
auggaugcuaugaaaagagguuuauguuguguuuuauuauuauguggagcuguauuuguaaguccaagu

SEQ ID NO: 1555 - RNA, 63 nt, Artificial Sequence
  derived and/or modified CDS sequence (opt6) from Homo sapiens__AAA61213.1__signal peptide-HsPLAT
auggaugcgaugaagagaggguuauguuguguguuauuguuauguggagcgguauuuguaagu

SEQ ID NO: 1556 - RNA, 66 nt, Artificial Sequence
  derived and/or modified CDS sequence (opt6) from Homo sapiens__AAA61213.1__signal peptide-HsPLAT
auggaugcaaugaaaagaggauuauguuguguauuauuauuauguggagcaguauuuguaagucca

SEQ ID NO: 1557 - RNA, 81 nt, Artificial Sequence
  derived and/or modified CDS sequence (opt6) from Homo sapiens__NP_000790.2__signal peptide-HsEPO
auggguguacaugaauguccagcuuggcuuuggcuuuuacuuucacuuuuaucuuuaccuuuagguuuaccuguacuugga

SEQ ID NO: 1558 - RNA, 54 nt, Artificial Sequence
  derived and/or modified CDS sequence (opt6) from Homo sapiens__AAB59424.1__signal peptide-IgE
auggacuggacauggauauuauuuuuaguagcagcagcaacaagaguacauuca

SEQ ID NO: 1559 - RNA, 72 nt, Artificial Sequence
  derived and/or modified CDS sequence (opt6) from Homo sapiens__NP_055022.2__signal peptide-HsCD5
augccuauggguucacuucaaccuuuagcuacacuuuaucuuuuagguaugcuuguagcuucauguuuaggu

SEQ ID NO: 1560 - RNA, 60 nt, Artificial Sequence
  derived and/or modified CDS sequence (opt6) from Homo sapiens__NP_000577.2__signal peptide-HsIL2
auguaccguaugcaacuacuuucauguauagcucuaucucuagcucuaguuacaaauuca

SEQ ID NO: 1561 - RNA, 54 nt, Artificial Sequence
  derived and/or modified CDS sequence (opt6) from Homo sapiens__NP_001020371.3 __signal peptide-HsCTRB2
auggcuuuuuuaugguuauuaucuuguugggcuuuauuagguacuacuuuuggu

SEQ ID NO: 1562 - RNA, 57 nt, Artificial Sequence
  derived and/or modified CDS sequence (opt6) from Homo sapiens__BAC87457.1__signal peptide-immunoglobulin (IgG heavy chain)
auggaauuugguuuaucuuggguuuuuuuaguugcuuuauuuagagguguucagugu

SEQ ID NO: 1563 - RNA, 57 nt, Artificial Sequence
  derived and/or modified CDS sequence (opt6) from Homo sapiens__AAA52897.1__signal peptide-human immunoglobulin heavy chain
auggauuggacuuggcguguauuuuguuuauuagcuguaacuccaggugcacaucca

SEQ ID NO: 1564 - RNA, 57 nt, Artificial Sequence
  derived and/or modified CDS sequence (opt6) from Homo sapiens__AAA59018.1__signal peptide-human immunoglobulin light chain
auggccuggaguccauuauuuuuaacauuaauaacucauugugcaggcucaugggca

SEQ ID NO: 1565 - RNA, 51 nt, Artificial Sequence
  derived and/or modified CDS sequence (opt6) from Gaussia princeps__AAG54095.1__signal peptide-GpLuc
augggaguaaaaguacuauuugcauuaauauguauagcaguagcagaagca

SEQ ID NO: 1566 - RNA, 63 nt, Artificial Sequence
  derived and/or modified CDS sequence (opt6) from Mus musculus__BAR42292.1__signal peptide-MmIgkappa
auggaaacagauacauuauuauuauggguuuuauuauuauggguaccuggaaguacaggugac

SEQ ID NO: 1567 - RNA, 72 nt, Artificial Sequence
  derived and/or modified CDS sequence (opt7) from Homo sapiens__AAA59606.1__signal peptide-HLA-A2-SP
auggccgugauggcacccaggacccugguccuccuguugagcggcgcccuggcgcucacucagaccugggcc

SEQ ID NO: 1568 - RNA, 69 nt, Artificial Sequence
  derived and/or modified CDS sequence (opt7) from Homo sapiens__AAA61213.1__signal peptide-HsPLAT
auggacgccaugaagaggggccugugcugugugcuccuguugugcggggcagucuucgugagccccucc

SEQ ID NO: 1569 - RNA, 63 nt, Artificial Sequence
  derived and/or modified CDS sequence (opt7) from Homo sapiens__AAA61213.1__signal peptide-HsPLAT
auggacgccaugaagaggggccugugcugugugcuccuguugugcggggcagucuucgugagc

SEQ ID NO: 1570 - RNA, 66 nt, Artificial Sequence
  derived and/or modified CDS sequence (opt7) from Homo sapiens__AAA61213.1__signal peptide-HsPLAT
auggacgccaugaagaggggccugugcugugugcuccuguugugcggggcagucuucgugagcccc

SEQ ID NO: 1571 - RNA, 81 nt, Artificial Sequence
  derived and/or modified CDS sequence (opt7) from Homo sapiens__NP_000790.2__signal peptide-HsEPO
augggcgugcacgagugccccgccuggcuguggcuccuguugagccugcucucccugccauuggggcugccgguccucggu

SEQ ID NO: 1572 - RNA, 54 nt, Artificial Sequence
  derived and/or modified CDS sequence (opt7) from Homo sapiens__AAB59424.1__signal peptide-IgE
auggacuggaccuggauccuguuccucguggccgcagccacuaggguccacagc

SEQ ID NO: 1573 - RNA, 72 nt, Artificial Sequence
  derived and/or modified CDS sequence (opt7) from Homo sapiens__NP_055022.2__signal peptide-HsCD5
augcccaugggcagccugcagccacucgccacccuguacuugcuggggaugcucguggcauccugccugggu

SEQ ID NO: 1574 - RNA, 60 nt, Artificial Sequence
  derived and/or modified CDS sequence (opt7) from Homo sapiens__NP_000577.2__signal peptide-HsIL2
auguacaggaugcagcugcucagcugcaucgcccuguccuuggcacuggugaccaacagu

SEQ ID NO: 1575 - RNA, 54 nt, Artificial Sequence
  derived and/or modified CDS sequence (opt7) from Homo sapiens__NP_001020371.3 __signal peptide-HsCTRB2
auggccuuccuguggcuccugagcugcugggcauugcugggcaccacuuuuggg

SEQ ID NO: 1576 - RNA, 57 nt, Artificial Sequence
  derived and/or modified CDS sequence (opt7) from Homo sapiens__BAC87457.1__signal peptide-immunoglobulin (IgG heavy chain)
auggaguucgggcugagcuggguguuucucgucgcccuguucaggggcgugcagugc

SEQ ID NO: 1577 - RNA, 57 nt, Artificial Sequence
  derived and/or modified CDS sequence (opt7) from Homo sapiens__AAA52897.1__signal peptide-human immunoglobulin heavy chain
auggacuggaccuggaggguguucugccugcucgccgucacucccggcgcacaccca

SEQ ID NO: 1578 - RNA, 57 nt, Artificial Sequence
  derived and/or modified CDS sequence (opt7) from Homo sapiens__AAA59018.1__signal peptide-human immunoglobulin light chain
auggccuggagcccccuguuccucacccugaucacucacugcgcaggcuccugggcc

SEQ ID NO: 1579 - RNA, 51 nt, Artificial Sequence
  derived and/or modified CDS sequence (opt7) from Gaussia princeps__AAG54095.1__signal peptide-GpLuc
augggcgugaagguccuguucgcccucaucugcauugcaguggccgaggcg

SEQ ID NO: 1580 - RNA, 63 nt, Artificial Sequence
  derived and/or modified CDS sequence (opt7) from Mus musculus__BAR42292.1__signal peptide-MmIgkappa
auggagaccgacacucugcuccuguggguguugcugcucuggguccccggcagcaccggggau

SEQ ID NO: 1581 - RNA, 72 nt, Artificial Sequence
  derived and/or modified CDS sequence (opt8) from Homo sapiens__AAA59606.1__signal peptide-HLA-A2-SP
auggcggucauggccccgagaacgcuagugcuauugcucucgggcgcgcucgcgcucacgcaaacgugggcg

SEQ ID NO: 1582 - RNA, 69 nt, Artificial Sequence
  derived and/or modified CDS sequence (opt8) from Homo sapiens__AAA61213.1__signal peptide-HsPLAT
auggacgcgaugaagcgcgggcucugcugcguacuacugcucugcggcgcgguauucgucucaccauca

SEQ ID NO: 1583 - RNA, 63 nt, Artificial Sequence
  derived and/or modified CDS sequence (opt8) from Homo sapiens__AAA61213.1__signal peptide-HsPLAT
auggaugcgaugaagaggggguuguguuguguguuguuguuguguggggcgguguuugugagu

SEQ ID NO: 1584 - RNA, 66 nt, Artificial Sequence
  derived and/or modified CDS sequence (opt8) from Homo sapiens__AAA61213.1__signal peptide-HsPLAT
auggacgcgaugaagagagggcucuguugcgugcuauugcucuguggcgcggucuuugucucgccc

SEQ ID NO: 1585 - RNA, 81 nt, Artificial Sequence
  derived and/or modified CDS sequence (opt8) from Homo sapiens__NP_000790.2__signal peptide-HsEPO
augggcgugcacgagugcccggccuggcucuggcucuugcucucgcucuugagcuugcccuugggcuugcccgugcucggg

SEQ ID NO: 1586 - RNA, 54 nt, Artificial Sequence
  derived and/or modified CDS sequence (opt8) from Homo sapiens__AAB59424.1__signal peptide-IgE
auggacuggacguggauacucuuucucguagccgcggccacgcgcgugcacuca

SEQ ID NO: 1587 - RNA, 72 nt, Artificial Sequence
  derived and/or modified CDS sequence (opt8) from Homo sapiens__NP_055022.2__signal peptide-HsCD5
augcccaugggcucacuccaaccccuagccacccucuaccuccucggcaugcucgucgccucaugccucggc

SEQ ID NO: 1588 - RNA, 60 nt, Artificial Sequence
  derived and/or modified CDS sequence (opt8) from Homo sapiens__NP_000577.2__signal peptide-HsIL2
auguaccgcaugcaauuacucuccugcaucgcccuaucccucgcccuagucaccaacucc

SEQ ID NO: 1589 - RNA, 54 nt, Artificial Sequence
  derived and/or modified CDS sequence (opt8) from Homo sapiens__NP_001020371.3 __signal peptide-HsCTRB2
auggccuuccuuuggcucuuauccugcugggcucuccucggcaccaccuucggc

SEQ ID NO: 1590 - RNA, 57 nt, Artificial Sequence
  derived and/or modified CDS sequence (opt8) from Homo sapiens__BAC87457.1__signal peptide-immunoglobulin (IgG heavy chain)
auggaguucgggcucucauggguguucuuggucgcacucuuucgcgggguccagugc

SEQ ID NO: 1591 - RNA, 57 nt, Artificial Sequence
  derived and/or modified CDS sequence (opt8) from Homo sapiens__AAA52897.1__signal peptide-human immunoglobulin heavy chain
auggacuggaccuggcgcguauucugccuacuagccguaacccccggcgcccaccca

SEQ ID NO: 1592 - RNA, 57 nt, Artificial Sequence
  derived and/or modified CDS sequence (opt8) from Homo sapiens__AAA59018.1__signal peptide-human immunoglobulin light chain
auggccugguccccacucuuccucacacucaucacccacugcgccggcuccugggcc

SEQ ID NO: 1593 - RNA, 51 nt, Artificial Sequence
  derived and/or modified CDS sequence (opt8) from Gaussia princeps__AAG54095.1__signal peptide-GpLuc
augggggugaaggugcuguuugcguugauauguauagcgguggcggaggcg

SEQ ID NO: 1594 - RNA, 63 nt, Artificial Sequence
  derived and/or modified CDS sequence (opt8) from Mus musculus__BAR42292.1__signal peptide-MmIgkappa
auggaaaccgacacacuccuacucuggguccuccuccucuggguccccggcuccaccggcgac

SEQ ID NO: 1595 - RNA, 72 nt, Artificial Sequence
  derived and/or modified CDS sequence (opt9) from Homo sapiens__AAA59606.1__signal peptide-HLA-A2-SP
auggcggucauggccccgcgaacgcucgugcucuugcucucaggcgcgcucgcgcucacgcaaacgugggcg

SEQ ID NO: 1596 - RNA, 69 nt, Artificial Sequence
  derived and/or modified CDS sequence (opt9) from Homo sapiens__AAA61213.1__signal peptide-HsPLAT
auggacgcgaugaagcgcgggcucuguugcgugcucuugcucuguggcgcggucuuugucucgccaucg

SEQ ID NO: 1597 - RNA, 63 nt, Artificial Sequence; identical to SEQ ID NO: 1583
  derived and/or modified CDS sequence (opt9) from Homo sapiens__AAA61213.1__signal peptide-HsPLAT

SEQ ID NO: 1598 - RNA, 66 nt, Artificial Sequence
  derived and/or modified CDS sequence (opt9) from Homo sapiens__AAA61213.1__signal peptide-HsPLAT
auggacgccaugaaacgaggccucugcugcguccuacuccucugcggcgccguauucgucuccccc

SEQ ID NO: 1599 - RNA, 81 nt, Artificial Sequence; identical to SEQ ID NO: 1585
  derived and/or modified CDS sequence (opt9) from Homo sapiens__NP_000790.2__signal peptide-HsEPO

SEQ ID NO: 1600 - RNA, 54 nt, Artificial Sequence
  derived and/or modified CDS sequence (opt9) from Homo sapiens__AAB59424.1__signal peptide-IgE
auggacuggaccuggauacucuuucucgucgccgccgccacccgcguccacuca

SEQ ID NO: 1601 - RNA, 72 nt, Artificial Sequence
  derived and/or modified CDS sequence (opt9) from Homo sapiens__NP_055022.2__signal peptide-HsCD5
augcccaugggcucccuccaaccccuagccacacucuaccuccucggcaugcucgucgccuccugccuaggc

SEQ ID NO: 1602 - RNA, 60 nt, Artificial Sequence
  derived and/or modified CDS sequence (opt9) from Homo sapiens__NP_000577.2__signal peptide-HsIL2
auguaccgcaugcaacuccuauccugcaucgcccucucacucgcccucguaaccaacucc

SEQ ID NO: 1603 - RNA, 54 nt, Artificial Sequence
  derived and/or modified CDS sequence (opt9) from Homo sapiens__NP_001020371.3 __signal peptide-HsCTRB2
auggccuuccucuggcuccucucauguugggcccuacucggcaccaccuucgga

SEQ ID NO: 1604 - RNA, 57 nt, Artificial Sequence
  derived and/or modified CDS sequence (opt9) from Homo sapiens__BAC87457.1__signal peptide-immunoglobulin (IgG heavy chain)
auggaguucgggcucucguggguguucuuggucgcgcucuuucgcgggguccagugc

SEQ ID NO: 1605 - RNA, 57 nt, Artificial Sequence
  derived and/or modified CDS sequence (opt9) from Homo sapiens__AAA52897.1__signal peptide-human immunoglobulin heavy chain
auggacuggaccuggcgcguauucugccuccuagccguaacccccggcgcccaccca

SEQ ID NO: 1606 - RNA, 57 nt, Artificial Sequence; identical to SEQ ID NO: 1592
  derived and/or modified CDS sequence (opt9) from Homo sapiens__AAA59018.1__signal peptide-human immunoglobulin light chain

SEQ ID NO: 1607 - RNA, 51 nt, Artificial Sequence; identical to SEQ ID NO: 1593
  derived and/or modified CDS sequence (opt9) from Gaussia princeps__AAG54095.1__signal peptide-GpLuc

SEQ ID NO: 1608 - RNA, 63 nt, Artificial Sequence; identical to SEQ ID NO: 1594
  derived and/or modified CDS sequence (opt9) from Mus musculus__BAR42292.1__signal peptide-MmIgkappa

SEQ ID NO: 1609 - RNA, 72 nt, Artificial Sequence
  derived and/or modified CDS sequence (opt11) from Homo sapiens__AAA59606.1__signal peptide-HLA-A2-SP
auggccgucauggccccccgcacccucguccuccuccucuccggcgcccucgcccucacccaaaccugggcc

SEQ ID NO: 1610 - RNA, 69 nt, Artificial Sequence
  derived and/or modified CDS sequence (opt11) from Homo sapiens__AAA61213.1__signal peptide-HsPLAT
auggacgccaugaaacgcggccucugcugcguccuccuccucugcggcgccgucuucgucucccccucc

SEQ ID NO: 1611 - RNA, 63 nt, Artificial Sequence
  derived and/or modified CDS sequence (opt11) from Homo sapiens__AAA61213.1__signal peptide-HsPLAT
auggacgcgaugaagcgcgggcucuguugcgugcucuugcucuguggcgcggucuuugucucg

SEQ ID NO: 1612 - RNA, 66 nt, Artificial Sequence
  derived and/or modified CDS sequence (opt11) from Homo sapiens__AAA61213.1__signal peptide-HsPLAT
auggaugcgaugaagaggggguuguguuguguguuguuguuguguggggcgguguuugugaguccg

SEQ ID NO: 1613 - RNA, 81 nt, Artificial Sequence; identical to SEQ ID NO: 1585
  derived and/or modified CDS sequence (opt11) from Homo sapiens__NP_000790.2__signal peptide-HsEPO

SEQ ID NO: 1614 - RNA, 54 nt, Artificial Sequence
  derived and/or modified CDS sequence (opt11) from Homo sapiens__AAB59424.1__signal peptide-IgE
auggauuggacguggauacucuuucucguggccgcggccacgcgcgugcacucg

SEQ ID NO: 1615 - RNA, 72 nt, Artificial Sequence
  derived and/or modified CDS sequence (opt11) from Homo sapiens__NP_055022.2__signal peptide-HsCD5
augcccaugggcucccuccaaccccucgccacccucuaccuccucggcaugcucgucgccuccugccucggc

SEQ ID NO: 1616 - RNA, 60 nt, Artificial Sequence
  derived and/or modified CDS sequence (opt11) from Homo sapiens__NP_000577.2__signal peptide-HsIL2
auguaccgcaugcaacuccucuccugcaucgcccucucccucgcccucgucaccaacucc

SEQ ID NO: 1617 - RNA, 54 nt, Artificial Sequence; identical to SEQ ID NO: 1505
  derived and/or modified CDS sequence (opt11) from Homo sapiens__NP_001020371.3 __signal peptide-HsCTRB2

SEQ ID NO: 1618 - RNA, 57 nt, Artificial Sequence; identical to SEQ ID NO: 1604
  derived and/or modified CDS sequence (opt11) from Homo sapiens__BAC87457.1__signal peptide-immunoglobulin (IgG heavy chain)

SEQ ID NO: 1619 - RNA, 57 nt, Artificial Sequence
  derived and/or modified CDS sequence (opt11) from Homo sapiens__AAA52897.1__signal peptide-human immunoglobulin heavy chain
auggacuggaccuggcgcguguucugucucuuggccgugaccccgggcgcgcacccg

SEQ ID NO: 1620 - RNA, 57 nt, Artificial Sequence; identical to SEQ ID NO: 1592
  derived and/or modified CDS sequence (opt11) from Homo sapiens__AAA59018.1__signal peptide-human immunoglobulin light chain

SEQ ID NO: 1621 - RNA, 51 nt, Artificial Sequence
  derived and/or modified CDS sequence (opt11) from Gaussia princeps__AAG54095.1__signal peptide-GpLuc
augggcgugaaagugcucuuugccuugaucuguaucgcggucgcggaagcg

SEQ ID NO: 1622 - RNA, 63 nt, Artificial Sequence; identical to SEQ ID NO: 1594
  derived and/or modified CDS sequence (opt11) from Mus musculus__BAR42292.1__signal peptide-MmIgkappa

SEQ ID NO: 1623 - RNA, 72 nt, Artificial Sequence; identical to SEQ ID NO: 1553
  derived and/or modified CDS sequence (opt12) from Homo sapiens__AAA59606.1__signal peptide-HLA-A2-SP

SEQ ID NO: 1624 - RNA, 69 nt, Artificial Sequence
  derived and/or modified CDS sequence (opt12) from Homo sapiens__AAA61213.1__signal peptide-HsPLAT
auggaugcuaugaaaagagguuuauguuguguuuuauuauuauguggagcuguauuuguaucuccaucu

SEQ ID NO: 1625 - RNA, 63 nt, Artificial Sequence; identical to SEQ ID NO: 1555
  derived and/or modified CDS sequence (opt12) from Homo sapiens__AAA61213.1__signal peptide-HsPLAT

SEQ ID NO: 1626 - RNA, 66 nt, Artificial Sequence; identical to SEQ ID NO: 1556
  derived and/or modified CDS sequence (opt12) from Homo sapiens__AAA61213.1__signal peptide-HsPLAT

SEQ ID NO: 1627 - RNA, 81 nt, Artificial Sequence; identical to SEQ ID NO: 1557
  derived and/or modified CDS sequence (opt12) from Homo sapiens__NP_000790.2__signal peptide-HsEPO

SEQ ID NO: 1628 - RNA, 54 nt, Artificial Sequence; identical to SEQ ID NO: 1558
  derived and/or modified CDS sequence (opt12) from Homo sapiens__AAB59424.1__signal peptide-IgE

SEQ ID NO: 1629 - RNA, 72 nt, Artificial Sequence; identical to SEQ ID NO: 1559
  derived and/or modified CDS sequence (opt12) from Homo sapiens__NP_055022.2__signal peptide-HsCD5

SEQ ID NO: 1630 - RNA, 60 nt, Artificial Sequence
  derived and/or modified CDS sequence (opt12) from Homo sapiens__NP_000577.2__signal peptide-HsIL2
auguacagaaugcaacuacuaucaugcauagcacuaucacuagcucuaguaacaaacuca

SEQ ID NO: 1631 - RNA, 54 nt, Artificial Sequence
  derived and/or modified CDS sequence (opt12) from Homo sapiens__NP_001020371.3 __signal peptide-HsCTRB2
auggcauuuuuaugguuauuaucauguugggcuuuauuaggaacuacauuugga

SEQ ID NO: 1632 - RNA, 57 nt, Artificial Sequence
  derived and/or modified CDS sequence (opt12) from Homo sapiens__BAC87457.1__signal peptide-immunoglobulin (IgG heavy chain)
auggaauuuggauuaaguuggguauuuuuaguugcauuauuuagaggaguucagugu

SEQ ID NO: 1633 - RNA, 57 nt, Artificial Sequence
  derived and/or modified CDS sequence (opt12) from Homo sapiens__AAA52897.1__signal peptide-human immunoglobulin heavy chain
auggacuggacauggagaguauuuuguuuauuagcaguaacaccaggagcacaucca

SEQ ID NO: 1634 - RNA, 57 nt, Artificial Sequence; identical to SEQ ID NO: 1564
  derived and/or modified CDS sequence (opt12) from Homo sapiens__AAA59018.1__signal peptide-human immunoglobulin light chain

SEQ ID NO: 1635 - RNA, 51 nt, Artificial Sequence; identical to SEQ ID NO: 1565
  derived and/or modified CDS sequence (opt12) from Gaussia princeps__AAG54095.1__signal peptide-GpLuc

SEQ ID NO: 1636 - RNA, 63 nt, Artificial Sequence
  derived and/or modified CDS sequence (opt12) from Mus musculus__BAR42292.1__signal peptide-MmIgkappa
auggaaacagauacauuauuauuauggguauuauuauuauggguaccaggaaguacaggagac

SEQ ID NO: 1637 - RNA, 72 nt, Artificial Sequence; identical to SEQ ID NO: 1553
  derived and/or modified CDS sequence (opt13) from Homo sapiens__AAA59606.1__signal peptide-HLA-A2-SP

SEQ ID NO: 1638 - RNA, 69 nt, Artificial Sequence
  derived and/or modified CDS sequence (opt13) from Homo sapiens__AAA61213.1__signal peptide-HsPLAT
auggaugcaaugaaaagaggauuauguuguguauuauuauuauguggagcaguauuuguaaguccaagu

SEQ ID NO: 1639 - RNA, 63 nt, Artificial Sequence
  derived and/or modified CDS sequence (opt13) from Homo sapiens__AAA61213.1__signal peptide-HsPLAT
auggaugcuaugaagagagguuuauguuguguuuuauuguuauguggagcuguauuuguaagu

SEQ ID NO: 1640 - RNA, 66 nt, Artificial Sequence; identical to SEQ ID NO: 1556
  derived and/or modified CDS sequence (opt13) from Homo sapiens__AAA61213.1__signal peptide-HsPLAT

SEQ ID NO: 1641 - RNA, 81 nt, Artificial Sequence; identical to SEQ ID NO: 1557
  derived and/or modified CDS sequence (opt13) from Homo sapiens__NP_000790.2__signal peptide-HsEPO

SEQ ID NO: 1642 - RNA, 54 nt, Artificial Sequence; identical to SEQ ID NO: 1558
  derived and/or modified CDS sequence (opt13) from Homo sapiens__AAB59424.1__signal peptide-IgE

SEQ ID NO: 1643 - RNA, 72 nt, Artificial Sequence; identical to SEQ ID NO: 1559
  derived and/or modified CDS sequence (opt13) from Homo sapiens__NP_055022.2__signal peptide-HsCD5

SEQ ID NO: 1644 - RNA, 60 nt, Artificial Sequence; identical to SEQ ID NO: 1630
  derived and/or modified CDS sequence (opt13) from Homo sapiens__NP_000577.2__signal peptide-HsIL2

SEQ ID NO: 1645 - RNA, 54 nt, Artificial Sequence; identical to SEQ ID NO: 1561
  derived and/or modified CDS sequence (opt13) from Homo sapiens__NP_001020371.3 __signal peptide-HsCTRB2

SEQ ID NO: 1646 - RNA, 57 nt, Artificial Sequence; identical to SEQ ID NO: 1632
  derived and/or modified CDS sequence (opt13) from Homo sapiens__BAC87457.1__signal peptide-immunoglobulin (IgG heavy chain)

SEQ ID NO: 1647 - RNA, 57 nt, Artificial Sequence; identical to SEQ ID NO: 1633
  derived and/or modified CDS sequence (opt13) from Homo sapiens__AAA52897.1__signal peptide-human immunoglobulin heavy chain

SEQ ID NO: 1648 - RNA, 57 nt, Artificial Sequence; identical to SEQ ID NO: 1564
  derived and/or modified CDS sequence (opt13) from Homo sapiens__AAA59018.1__signal peptide-human immunoglobulin light chain

SEQ ID NO: 1649 - RNA, 51 nt, Artificial Sequence; identical to SEQ ID NO: 1565
  derived and/or modified CDS sequence (opt13) from Gaussia princeps__AAG54095.1__signal peptide-GpLuc

SEQ ID NO: 1650 - RNA, 63 nt, Artificial Sequence; identical to SEQ ID NO: 1636
  derived and/or modified CDS sequence (opt13) from Mus musculus__BAR42292.1__signal peptide-MmIgkappa

SEQ ID NO: 1651 - protein, 1008 aa, Artificial Sequence
  derived and/or modified CDS sequence (wt) from Clostridium histolyticum__BAA77453.1__ColG(111-1118)
IANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 1652 - protein, 1124 aa, Artificial Sequence
  derived and/or modified CDS sequence (wt) from Clostridium histolyticum__BAA77453.1__ColG(1-110)_CS-F_ColG(111-1118)
MKKNILKILMDSYSKESKIQTVRRVTSVSLLAVYLTMNTSSLVLAKPIENTNDTSIKNVEKLRNAPNEENSKKVEDSKNDKVEHVKNIEEAKVEQVAPEVKSKSTLRSASRRRRKRIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 1653 - protein, 981 aa, Artificial Sequence
  derived and/or modified CDS sequence (wt) from Clostridium histolyticum__BAA34542.1__ColH(41-1021)
VQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 1654 - protein, 1027 aa, Artificial Sequence
  derived and/or modified CDS sequence (wt) from Clostridium histolyticum__BAA34542.1__ColH(1-40)_CS-F_ColH(41-1021)
MKRKCLSKRLMLAITMATIFTVNSTLPIYAAVDKNNATAARRRRKRVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 1655 - RNA, 3027 nt, Artificial Sequence
  derived and/or modified CDS sequence (wt) from Clostridium histolyticum__BAA77453.1__ColG(111-1118)
auagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 1656 - RNA, 3027 nt, Artificial Sequence
  derived and/or modified CDS sequence (wt) from Clostridium histolyticum__BAA77453.1__ColG(111-1118)
auagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 1657 - RNA, 3375 nt, Artificial Sequence
  derived and/or modified CDS sequence (wt) from Clostridium histolyticum__BAA77453.1__ColG(1-110)_CS-F_ColG(111-1118)
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 1658 - RNA, 3375 nt, Artificial Sequence
  derived and/or modified CDS sequence (wt) from Clostridium histolyticum__BAA77453.1__ColG(1-110)_CS-F_ColG(111-1118)
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 1659 - RNA, 2946 nt, Artificial Sequence
  derived and/or modified CDS sequence (wt) from Clostridium histolyticum__BAA34542.1__ColH(41-1021)
guacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 1660 - RNA, 2946 nt, Artificial Sequence
  derived and/or modified CDS sequence (wt) from Clostridium histolyticum__BAA34542.1__ColH(41-1021)
guacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 1661 - RNA, 3084 nt, Artificial Sequence
  derived and/or modified CDS sequence (wt) from Clostridium histolyticum__BAA34542.1__ColH(1-40)_CS-F_ColH(41-1021)
augaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 1662 - RNA, 3084 nt, Artificial Sequence
  derived and/or modified CDS sequence (wt) from Clostridium histolyticum__BAA34542.1__ColH(1-40)_CS-F_ColH(41-1021)
augaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 1663 - RNA, 3027 nt, Artificial Sequence
  derived and/or modified CDS sequence (opt1) from Clostridium histolyticum__BAA77453.1__ColG(111-1118)
aucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 1664 - RNA, 3375 nt, Artificial Sequence
  derived and/or modified CDS sequence (opt1) from Clostridium histolyticum__BAA77453.1__ColG(1-110)_CS-F_ColG(111-1118)
augaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 1665 - RNA, 2946 nt, Artificial Sequence
  derived and/or modified CDS sequence (opt1) from Clostridium histolyticum__BAA34542.1__ColH(41-1021)
gugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 1666 - RNA, 3084 nt, Artificial Sequence
  derived and/or modified CDS sequence (opt1) from Clostridium histolyticum__BAA34542.1__ColH(1-40)_CS-F_ColH(41-1021)
augaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 1667 - RNA, 3027 nt, Artificial Sequence
  derived and/or modified CDS sequence (opt2) from Clostridium histolyticum__BAA77453.1__ColG(111-1118)
aucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 1668 - RNA, 3375 nt, Artificial Sequence
  derived and/or modified CDS sequence (opt2) from Clostridium histolyticum__BAA77453.1__ColG(1-110)_CS-F_ColG(111-1118)
augaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 1669 - RNA, 2946 nt, Artificial Sequence
  derived and/or modified CDS sequence (opt2) from Clostridium histolyticum__BAA34542.1__ColH(41-1021)
guccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 1670 - RNA, 3084 nt, Artificial Sequence
  derived and/or modified CDS sequence (opt2) from Clostridium histolyticum__BAA34542.1__ColH(1-40)_CS-F_ColH(41-1021)
augaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 1671 - RNA, 3027 nt, Artificial Sequence
  derived and/or modified CDS sequence (opt3) from Clostridium histolyticum__BAA77453.1__ColG(111-1118)
auugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaaguga

SEQ ID NO: 1672 - RNA, 3375 nt, Artificial Sequence
  derived and/or modified CDS sequence (opt3) from Clostridium histolyticum__BAA77453.1__ColG(1-110)_CS-F_ColG(111-1118)
augaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaaguga

SEQ ID NO: 1673 - RNA, 2946 nt, Artificial Sequence
  derived and/or modified CDS sequence (opt3) from Clostridium histolyticum__BAA34542.1__ColH(41-1021)
guccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggagguga

SEQ ID NO: 1674 - RNA, 3084 nt, Artificial Sequence
  derived and/or modified CDS sequence (opt3) from Clostridium histolyticum__BAA34542.1__ColH(1-40)_CS-F_ColH(41-1021)
augaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccgguga

SEQ ID NO: 1675 - RNA, 3027 nt, Artificial Sequence
  derived and/or modified CDS sequence (opt4) from Clostridium histolyticum__BAA77453.1__ColG(111-1118)
aucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 1676 - RNA, 3375 nt, Artificial Sequence
  derived and/or modified CDS sequence (opt4) from Clostridium histolyticum__BAA77453.1__ColG(1-110)_CS-F_ColG(111-1118)
augaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 1677 - RNA, 2946 nt, Artificial Sequence
  derived and/or modified CDS sequence (opt4) from Clostridium histolyticum__BAA34542.1__ColH(41-1021)
gugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 1678 - RNA, 3084 nt, Artificial Sequence
  derived and/or modified CDS sequence (opt4) from Clostridium histolyticum__BAA34542.1__ColH(1-40)_CS-F_ColH(41-1021)
augaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 1679 - RNA, 3027 nt, Artificial Sequence
  derived and/or modified CDS sequence (opt5) from Clostridium histolyticum__BAA77453.1__ColG(111-1118)
auugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaaguga

SEQ ID NO: 1680 - RNA, 3375 nt, Artificial Sequence
  derived and/or modified CDS sequence (opt5) from Clostridium histolyticum__BAA77453.1__ColG(1-110)_CS-F_ColG(111-1118)
augaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaaguga

SEQ ID NO: 1681 - RNA, 2946 nt, Artificial Sequence
  derived and/or modified CDS sequence (opt5) from Clostridium histolyticum__BAA34542.1__ColH(41-1021)
guccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcuga

SEQ ID NO: 1682 - RNA, 3084 nt, Artificial Sequence
  derived and/or modified CDS sequence (opt5) from Clostridium histolyticum__BAA34542.1__ColH(1-40)_CS-F_ColH(41-1021)
augaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcuga

SEQ ID NO: 1683 - RNA, 3027 nt, Artificial Sequence
  derived and/or modified CDS sequence (opt6) from Clostridium histolyticum__BAA77453.1__ColG(111-1118)
auagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaa

SEQ ID NO: 1684 - RNA, 3375 nt, Artificial Sequence
  derived and/or modified CDS sequence (opt6) from Clostridium histolyticum__BAA77453.1__ColG(1-110)_CS-F_ColG(111-1118)
augaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaauga

SEQ ID NO: 1685 - RNA, 2946 nt, Artificial Sequence
  derived and/or modified CDS sequence (opt6) from Clostridium histolyticum__BAA34542.1__ColH(41-1021)
guacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaa

SEQ ID NO: 1686 - RNA, 3084 nt, Artificial Sequence
  derived and/or modified CDS sequence (opt6) from Clostridium histolyticum__BAA34542.1__ColH(1-40)_CS-F_ColH(41-1021)
augaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagauga

SEQ ID NO: 1687 - RNA, 3027 nt, Artificial Sequence
  derived and/or modified CDS sequence (opt7) from Clostridium histolyticum__BAA77453.1__ColG(111-1118)
auugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaaguga

SEQ ID NO: 1688 - RNA, 3375 nt, Artificial Sequence
  derived and/or modified CDS sequence (opt7) from Clostridium histolyticum__BAA77453.1__ColG(1-110)_CS-F_ColG(111-1118)
augaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaauga

SEQ ID NO: 1689 - RNA, 2946 nt, Artificial Sequence
  derived and/or modified CDS sequence (opt7) from Clostridium histolyticum__BAA34542.1__ColH(41-1021)
guccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcuga

SEQ ID NO: 1690 - RNA, 3084 nt, Artificial Sequence
  derived and/or modified CDS sequence (opt7) from Clostridium histolyticum__BAA34542.1__ColH(1-40)_CS-F_ColH(41-1021)
augaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcuga

SEQ ID NO: 1691 - RNA, 3027 nt, Artificial Sequence
  derived and/or modified CDS sequence (opt8) from Clostridium histolyticum__BAA77453.1__ColG(111-1118)
auagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaaguga

SEQ ID NO: 1692 - RNA, 3375 nt, Artificial Sequence
  derived and/or modified CDS sequence (opt8) from Clostridium histolyticum__BAA77453.1__ColG(1-110)_CS-F_ColG(111-1118)
augaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauag

SEQ ID NO: 1693 - RNA, 2946 nt, Artificial Sequence
  derived and/or modified CDS sequence (opt8) from Clostridium histolyticum__BAA34542.1__ColH(41-1021)
guccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcuga

SEQ ID NO: 1694 - RNA, 3084 nt, Artificial Sequence
  derived and/or modified CDS sequence (opt8) from Clostridium histolyticum__BAA34542.1__ColH(1-40)_CS-F_ColH(41-1021)
augaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcuga

SEQ ID NO: 1695 - RNA, 3027 nt, Artificial Sequence
  derived and/or modified CDS sequence (opt9) from Clostridium histolyticum__BAA77453.1__ColG(111-1118)
aucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaa

SEQ ID NO: 1696 - RNA, 3375 nt, Artificial Sequence
  derived and/or modified CDS sequence (opt9) from Clostridium histolyticum__BAA77453.1__ColG(1-110)_CS-F_ColG(111-1118)
augaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaa

SEQ ID NO: 1697 - RNA, 2946 nt, Artificial Sequence
  derived and/or modified CDS sequence (opt9) from Clostridium histolyticum__BAA34542.1__ColH(41-1021)
guacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaa

SEQ ID NO: 1698 - RNA, 3084 nt, Artificial Sequence
  derived and/or modified CDS sequence (opt9) from Clostridium histolyticum__BAA34542.1__ColH(1-40)_CS-F_ColH(41-1021)
augaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaa

SEQ ID NO: 1699 - RNA, 3027 nt, Artificial Sequence
  derived and/or modified CDS sequence (opt11) from Clostridium histolyticum__BAA77453.1__ColG(111-1118)
aucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaaguga

SEQ ID NO: 1700 - RNA, 3375 nt, Artificial Sequence
  derived and/or modified CDS sequence (opt11) from Clostridium histolyticum__BAA77453.1__ColG(1-110)_CS-F_ColG(111-1118)
augaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaaguga

SEQ ID NO: 1701 - RNA, 2946 nt, Artificial Sequence
  derived and/or modified CDS sequence (opt11) from Clostridium histolyticum__BAA34542.1__ColH(41-1021)
guccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccgguga

SEQ ID NO: 1702 - RNA, 3084 nt, Artificial Sequence
  derived and/or modified CDS sequence (opt11) from Clostridium histolyticum__BAA34542.1__ColH(1-40)_CS-F_ColH(41-1021)
augaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgauga

SEQ ID NO: 1703 - RNA, 3027 nt, Artificial Sequence
  derived and/or modified CDS sequence (opt12) from Clostridium histolyticum__BAA77453.1__ColG(111-1118)
auagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaauga

SEQ ID NO: 1704 - RNA, 3375 nt, Artificial Sequence
  derived and/or modified CDS sequence (opt12) from Clostridium histolyticum__BAA77453.1__ColG(1-110)_CS-F_ColG(111-1118)
augaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaa

SEQ ID NO: 1705 - RNA, 2946 nt, Artificial Sequence
  derived and/or modified CDS sequence (opt12) from Clostridium histolyticum__BAA34542.1__ColH(41-1021)
guacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaa

SEQ ID NO: 1706 - RNA, 3084 nt, Artificial Sequence
  derived and/or modified CDS sequence (opt12) from Clostridium histolyticum__BAA34542.1__ColH(1-40)_CS-F_ColH(41-1021)
augaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaa

SEQ ID NO: 1707 - RNA, 3027 nt, Artificial Sequence
  derived and/or modified CDS sequence (opt13) from Clostridium histolyticum__BAA77453.1__ColG(111-1118)
auagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaa

SEQ ID NO: 1708 - RNA, 3375 nt, Artificial Sequence
  derived and/or modified CDS sequence (opt13) from Clostridium histolyticum__BAA77453.1__ColG(1-110)_CS-F_ColG(111-1118)
augaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaa

SEQ ID NO: 1709 - RNA, 2946 nt, Artificial Sequence
  derived and/or modified CDS sequence (opt13) from Clostridium histolyticum__BAA34542.1__ColH(41-1021)
guacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaa

SEQ ID NO: 1710 - RNA, 3084 nt, Artificial Sequence
  derived and/or modified CDS sequence (opt13) from Clostridium histolyticum__BAA34542.1__ColH(1-40)_CS-F_ColH(41-1021)
augaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaa

SEQ ID NO: 1711 - DNA, 133 bp, Artificial Sequence
  3'-UTR of mouse NADH dehydrogenase (ubiquinone) 1 alpha subcomplex, 1 (Ndufa1)
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 1712 - RNA, 133 nt, Artificial Sequence
  3'-UTR of mouse NADH dehydrogenase (ubiquinone) 1 alpha subcomplex, 1 (Ndufa1) mRNA
ggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaa

SEQ ID NO: 1713 - DNA, 57 bp, Artificial Sequence
  3'-UTR of human proteasome subunit beta 3 (PSMB3)
ccctgttcccagagcccacttttttttctttttttgaaataaaatagcctgtctttc

SEQ ID NO: 1714 - RNA, 57 nt, Artificial Sequence
  3'-UTR of human proteasome subunit beta 3 (PSMB3) mRNA
cccuguucccagagcccacuuuuuuuucuuuuuuugaaauaaaauagccugucuuuc

SEQ ID NO: 1715 - DNA, 70 bp, Artificial Sequence
  3'-UTR of human ribosomal protein S9 (RPS9)
gtccacctgtccctcctgggctgctggattgtctcgttttcctgccaaataaacaggatcagcgctttac

SEQ ID NO: 1716 - RNA, 70 nt, Artificial Sequence
  3'-UTR of human ribosomal protein S9 (RPS9) mRNA
guccaccugucccuccugggcugcuggauugucucguuuuccugccaaauaaacaggaucagcgcuuuac

SEQ ID NO: 1717 - protein, 209 aa, Artificial Sequence
  derived and/or modified protein sequence (wt) from Homo sapiens__NP_061986.1__HsFGF21(L126R,P199G,A208E)
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRERLLEDGYNVYQSEAHGLPLHLPGNKSPHRDPAPRGPARFLPLPGLPPALPEPPGILAPQPPDVGSSDPLSMVGGSQGRSPSYES

SEQ ID NO: 1718 - protein, 728 aa, Artificial Sequence
  derived and/or modified protein sequence (wt) from Homo sapiens__NP_000592.3 P14210__HsHGF
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 1719 - protein, 728 aa, Artificial Sequence
  derived and/or modified protein sequence (wt) from Mus musculus__NP_001276387.1__MmHGF
MMWGTKLLPVLLLQHVLLHLLLLHVAIPYAEGQKKRRNTLHEFKKSAKTTLTKEDPLLKIKTKKVNSADECANRCIRNRGFTFTCKAFVFDKSRKRCYWYPFNSMSSGVKKGFGHEFDLYENKDYIRNCIIGKGGSYKGTVSITKSGIKCQPWNSMIPHEHSFLPSSYRGKDLQENYCRNPRGEEGGPWCFTSNPEVRYEVCDIPQCSEVECMTCNGESYRGPMDHTESGKTCQRWDQQTPHRHKFLPERYPDKGFDDNYCRNPDGKPRPWCYTLDPDTPWEYCAIKTCAHSAVNETDVPMETTECIQGQGEGYRGTSNTIWNGIPCQRWDSQYPHKHDITPENFKCKDLRENYCRNPDGAESPWCFTTDPNIRVGYCSQIPKCDVSSGQDCYRGNGKNYMGNLSKTRSGLTCSMWDKNMEDLHRHIFWEPDASKLNKNYCRNPDDDAHGPWCYTGNPLIPWDYCPISRCEGDTTPTIVNLDHPVISCAKTKQLRVVNGIPTQTTVGWMVSLKYRNKHICGGSLIKESWVLTARQCFPARNKDLKDYEAWLGIHDVHERGEEKRKQILNISQLVYGPEGSDLVLLKLARPAILDNFVSTIDLPSYGCTIPEKTTCSIYGWGYTGLINADGLLRVAHLYIMGNEKCSQHHQGKVTLNESELCAGAEKIGSGPCEGDYGGPLICEQHKMRMVLGVIVPGRGCAIPNRPGIFVRVAYYAKWIHKVILTYKL

SEQ ID NO: 1720 - protein, 205 aa, Artificial Sequence
  derived and/or modified protein sequence (wt) from Homo sapiens__NP_005253.3__HsGFER
MAAPGERGRFHGGNLFFLPGGARSEMMDDLATDARGRGAGRRDAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 1721 - RNA, 630 nt, Artificial Sequence
  derived and/or modified CDS sequence (wt) from Homo sapiens__NP_061986.1__HsFGF21(L126R,P199G,A208E)
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccuga

SEQ ID NO: 1722 - RNA, 630 nt, Artificial Sequence
  derived and/or modified CDS sequence (wt) from Homo sapiens__NP_061986.1__HsFGF21(L126R,P199G,A208E)
auggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccuga

SEQ ID NO: 1723 - RNA, 2187 nt, Artificial Sequence
  derived and/or modified CDS sequence (wt) from Homo sapiens__NP_000592.3__HsHGF
augugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauag

SEQ ID NO: 1724 - RNA, 2187 nt, Artificial Sequence
  derived and/or modified CDS sequence (wt) from Homo sapiens__NP_000592.3__HsHGF
augugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauag

SEQ ID NO: 1725 - RNA, 2187 nt, Artificial Sequence
  derived and/or modified CDS sequence (wt) from Mus musculus__NP_001276387.1__MmHGF
augaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaa

SEQ ID NO: 1726 - RNA, 2187 nt, Artificial Sequence
  derived and/or modified CDS sequence (wt) from Mus musculus__NP_001276387.1__MmHGF
augaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaa

SEQ ID NO: 1727 - RNA, 618 nt, Artificial Sequence
  derived and/or modified CDS sequence (wt) from Homo sapiens__NP_005253.3__HsGFER
auggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccugcacaaugaagugaaccgcaagcugggcaagccugacuucgacugcucaaaaguggaugagcgcuggcgcgacggcuggaaggauggcuccugugacuag

SEQ ID NO: 1728 - RNA, 618 nt, Artificial Sequence
  derived and/or modified CDS sequence (wt) from Homo sapiens__NP_005253.3__HsGFER
auggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccuccacaaugaagugaaccgcaagcugggcaagccugacuucgacugcucaaaaguggaugagcgcuggcgcgacggcuggaaggauggcuccugugacuag

SEQ ID NO: 1729 - RNA, 630 nt, Artificial Sequence
  derived and/or modified CDS sequence (opt1) from Homo sapiens__NP_061986.1__HsFGF21(L126R,P199G,A208E)
auggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcuga

SEQ ID NO: 1730 - RNA, 2187 nt, Artificial Sequence
  derived and/or modified CDS sequence (opt1) from Homo sapiens__NP_000592.3__HsHGF
augugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcuga

SEQ ID NO: 1731 - RNA, 2187 nt, Artificial Sequence
  derived and/or modified CDS sequence (opt1) from Mus musculus__NP_001276387.1__MmHGF
augauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucuga

SEQ ID NO: 1732 - RNA, 618 nt, Artificial Sequence
  derived and/or modified CDS sequence (opt1) from Homo sapiens__NP_005253.3__HsGFER
auggccgcccccggcgagcgcgggcgguuccacggcgggaaccuguucuuccugccgggcggggcgcgcagcgagaugauggacgaccuggccaccgacgcccggggccgcggcgccgggcggcgcgacgccgcggccuccgccagcacccccgcccaggcgcccacguccgacagccccguggccgaggacgccucccggcgccggccgugccgcgccugcgucgacuucaagaccuggaugcggacccagcagaagcgcgacaccaaguuccgggaggacugcccgcccgaccgcgaggagcugggccggcacagcugggccgugcuccacacgcuggcggccuacuaccccgaccugcccacccccgagcagcagcaggacauggcccaguucauccaccucuucuccaaguucuaccccugcgaggagugcgccgaggaccugcgcaagcggcugugccgcaaccaccccgacacccggacccgcgccugcuucacgcaguggcucugccaccuccacaacgaggugaaccggaagcuggggaagccggacuucgacugcagcaaggucgacgagcgcuggcgcgacggcuggaaggacggguccugcgacuga

SEQ ID NO: 1733 - RNA, 630 nt, Artificial Sequence
  derived and/or modified CDS sequence (opt2) from Homo sapiens__NP_061986.1__HsFGF21(L126R,P199G,A208E)
auggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccuga

SEQ ID NO: 1734 - RNA, 2187 nt, Artificial Sequence
  derived and/or modified CDS sequence (opt2) from Homo sapiens__NP_000592.3__HsHGF
augugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccuga

SEQ ID NO: 1735 - RNA, 2187 nt, Artificial Sequence
  derived and/or modified CDS sequence (opt2) from Mus musculus__NP_001276387.1__MmHGF
augauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucuga

SEQ ID NO: 1736 - RNA, 618 nt, Artificial Sequence
  derived and/or modified CDS sequence (opt2) from Homo sapiens__NP_005253.3__HsGFER
auggccgcccccggcgagcgcggccgcuuccacggcggcaaccucuucuuccuccccggcggcgcccgcuccgagaugauggacgaccucgccaccgacgcccgcggccgcggcgccggccgccgcgacgccgccgccuccgccuccacccccgcccaggcccccaccuccgacucccccgucgccgaggacgccucccgccgccgccccugccgcgccugcgucgacuucaagaccuggaugcgcacccagcagaagcgcgacaccaaguuccgcgaggacugcccccccgaccgcgaggagcucggccgccacuccugggccguccuccacacccucgccgccuacuaccccgaccuccccacccccgagcagcagcaggacauggcccaguucauccaccucuucuccaaguucuaccccugcgaggagugcgccgaggaccuccgcaagcgccucugccgcaaccaccccgacacccgcacccgcgccugcuucacccaguggcucugccaccuccacaacgaggucaaccgcaagcucggcaagcccgacuucgacugcuccaaggucgacgagcgcuggcgcgacggcuggaaggacggcuccugcgacuga

SEQ ID NO: 1737 - RNA, 630 nt, Artificial Sequence
  derived and/or modified CDS sequence (opt3) from Homo sapiens__NP_061986.1__HsFGF21(L126R,P199G,A208E)
auggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcuga

SEQ ID NO: 1738 - RNA, 2187 nt, Artificial Sequence
  derived and/or modified CDS sequence (opt3) from Homo sapiens__NP_000592.3__HsHGF
augugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcuga

SEQ ID NO: 1739 - RNA, 2187 nt, Artificial Sequence
  derived and/or modified CDS sequence (opt3) from Mus musculus__NP_001276387.1__MmHGF
augauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuuga

SEQ ID NO: 1740 - RNA, 618 nt, Artificial Sequence
  derived and/or modified CDS sequence (opt3) from Homo sapiens__NP_005253.3__HsGFER
auggccgcucccggcgagagagggagguuccacggagguaaccuguuuuuccucccuggcggggcacggagcgaaaugauggacgaucuugccaccgacgcgcgcggacgaggcgcuggucguagagaugccgcagccuccgcuucuacaccagcacaggccccgacuucagacagucccguggcugaggaugccagcaggcggcgcccuugcagagcgugugucgacuuuaagacguggaugaggacccaacagaaacgggauacaaaguuccgcgaagacugcccacccgaucgagaggaacuggggagacauuccugggcaguuuugcacacuuuagccgcuuacuauccugaccugccaacccccgagcagcagcaagauauggcccaguuuauccaucuauucucuaaauuuuacccuugugaggaaugcgcagaggaccucaggaagcggcugugucguaaucacccagauacacgcaccagagcuugcuucacucaguggcuuugucaucugcacaacgaagugaauaggaaauugggaaagccggacuuugacugcucgaagguagaugagcgguggcgagacggcuggaaagauggcucaugugacuga

SEQ ID NO: 1741 - RNA, 630 nt, Artificial Sequence
  derived and/or modified CDS sequence (opt4) from Homo sapiens__NP_061986.1__HsFGF21(L126R,P199G,A208E)
auggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcuga

SEQ ID NO: 1742 - RNA, 2187 nt, Artificial Sequence
  derived and/or modified CDS sequence (opt4) from Homo sapiens__NP_000592.3__HsHGF
augugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcuga

SEQ ID NO: 1743 - RNA, 2187 nt, Artificial Sequence
  derived and/or modified CDS sequence (opt4) from Mus musculus__NP_001276387.1__MmHGF
augauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcuguga

SEQ ID NO: 1744 - RNA, 618 nt, Artificial Sequence
  derived and/or modified CDS sequence (opt4) from Homo sapiens__NP_005253.3__HsGFER
auggccgcccccggcgagagaggcagauuccacggcggcaaccuguucuuccugcccggcggcgccagaagcgagaugauggacgaccuggccaccgacgccagaggcagaggcgccggcagaagagacgccgccgccagcgccagcacccccgcccaggcccccaccagcgacagccccguggccgaggacgccagcagaagaagacccugcagagccugcguggacuucaagaccuggaugagaacccagcagaagagagacaccaaguucagagaggacugcccccccgacagagaggagcugggcagacacagcugggccgugcugcacacccuggccgccuacuaccccgaccugcccacccccgagcagcagcaggacauggcccaguucauccaccuguucagcaaguucuaccccugcgaggagugcgccgaggaccugagaaagagacugugcagaaaccaccccgacaccagaaccagagccugcuucacccaguggcugugccaccugcacaacgaggugaacagaaagcugggcaagcccgacuucgacugcagcaagguggacgagagauggagagacggcuggaaggacggcagcugcgacuga

SEQ ID NO: 1745 - RNA, 630 nt, Artificial Sequence
  derived and/or modified CDS sequence (opt5) from Homo sapiens__NP_061986.1__HsFGF21(L126R,P199G,A208E)
auggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuuga

SEQ ID NO: 1746 - RNA, 2187 nt, Artificial Sequence
  derived and/or modified CDS sequence (opt5) from Homo sapiens__NP_000592.3__HsHGF
augugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuuga

SEQ ID NO: 1747 - RNA, 2187 nt, Artificial Sequence
  derived and/or modified CDS sequence (opt5) from Mus musculus__NP_001276387.1__MmHGF
augauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcuguga

SEQ ID NO: 1748 - RNA, 618 nt, Artificial Sequence
  derived and/or modified CDS sequence (opt5) from Homo sapiens__NP_005253.3__HsGFER
auggccgcucccggcgagagagggcgguuccacggaggcaaccuguuuuuccucccugggggagcccgcagcgaaaugauggacgaucuggcgaccgacgcuagaggccgcggggccggacggagagaugccgcugccuccgcuucuacaccggcccaggcgcccacgagcgacuccccuguggccgaggaugcuucucggcgcagacccugccgggccugugucgacuuuaagaccuggaugcgcacacaacagaaaagagauaccaaguuccgggaagacugcccucccgaucgcgaggaacuuggcagacauagcugggcuguucugcacacacucgccgcguacuauccugaccugccgacccccgagcagcagcaagauauggcccaguuuauccaucuuuucuccaaauuuuacccuugugaggaaugcgcugaggaccugcggaagcgccucuguagaaaucaccccgauacacggaccagagccugcuucacgcaguggcugugucaucugcacaacgaagugaaucgcaaacucggcaagccugacuuugacugcucuaagguggaugagcgguggagagacggguggaaagauggaagcugugacuga

SEQ ID NO: 1749 - RNA, 630 nt, Artificial Sequence
  derived and/or modified CDS sequence (opt6) from Homo sapiens__NP_061986.1__HsFGF21(L126R,P199G,A208E)
auggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaa

SEQ ID NO: 1750 - RNA, 2187 nt, Artificial Sequence
  derived and/or modified CDS sequence (opt6) from Homo sapiens__NP_000592.3__HsHGF
auguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaa

SEQ ID NO: 1751 - RNA, 2187 nt, Artificial Sequence
  derived and/or modified CDS sequence (opt6) from Mus musculus__NP_001276387.1__MmHGF
augauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaa

SEQ ID NO: 1752 - RNA, 618 nt, Artificial Sequence
  derived and/or modified CDS sequence (opt6) from Homo sapiens__NP_005253.3__HsGFER
auggcagcaccaggagaaagaggaagauuucaugggggaaauuuauuuuuucuaccaggaggugcaagaagugaaaugauggaugaucuggcaacagaugcaagaggaagaggagcaggaagaagagaugcagcagcaagcgcaaguacaccagcacaagcaccaacaagugauaguccaguagcagaagaugcaaguagaagaagaccauguagagcauguguagauuuuaaaacauggaugagaacacaacaaaaaagagauacaaaauuuagagaagacuguccaccagacagagaagaauuaggaagacauucaugggcaguauuacauacauuagcagcauauuauccagaucuaccaacgccagaacaacaacaagauauggcacaauuuauacauuuauuuaguaaauuuuauccaugugaagaaugugcagaagauuuaagaaaaagacuuuguagaaaucauccagauacaagaacaagagcauguuuuacacaaugguuaugucauuuacauaaugaaguaaauagaaaauuaggaaaaccagauuuugauuguagcaaaguagaugaaagauggagagauggauggaaagauggaaguugugauuaa

SEQ ID NO: 1753 - RNA, 630 nt, Artificial Sequence
  derived and/or modified CDS sequence (opt7) from Homo sapiens__NP_061986.1__HsFGF21(L126R,P199G,A208E)
auggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguuga

SEQ ID NO: 1754 - RNA, 2187 nt, Artificial Sequence
  derived and/or modified CDS sequence (opt7) from Homo sapiens__NP_000592.3__HsHGF
augugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcuga

SEQ ID NO: 1755 - RNA, 2187 nt, Artificial Sequence
  derived and/or modified CDS sequence (opt7) from Mus musculus__NP_001276387.1__MmHGF
augauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcuguga

SEQ ID NO: 1756 - RNA, 618 nt, Artificial Sequence
  derived and/or modified CDS sequence (opt7) from Homo sapiens__NP_005253.3__HsGFER
auggccgcacccggcgagagggggcgguuccacgguggcaaccuguuuuuccucccagggggcgcccgcagcgaaaugauggacgaucuggcgaccgacgccaggggucgcggggcaggccggagggaugccgcagccuccgcgaguacuccggcccaggcacccaccagcgacuccccaguggccgaggaugccagucggcgcaggcccugccgggcaugugucgacuuuaagacguggaugcgcacucaacagaaaagggauaccaaguuccgggaagacugcccacccgaucgcgaggaauugggcaggcauagcugggccgugcugcacacccucgcggccuacuauccagaccugccgacucccgagcagcagcaagauauggcacaguuuauccauuuguucuccaaauuuuacccaugugaggaaugcgccgaggaccugcggaagcgccucuguaggaaucaccccgauacccggacgcgcgcaugcuucacucaguggcugugucaucugcacaacgaaguaaauaggaaacucgggaagccagacuuugacugcagcaagguggaugagcgguggagggacgguuggaaagauggcuccugugacuga

SEQ ID NO: 1757 - RNA, 630 nt, Artificial Sequence
  derived and/or modified CDS sequence (opt8) from Homo sapiens__NP_061986.1__HsFGF21(L126R,P199G,A208E)
auggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaa

SEQ ID NO: 1758 - RNA, 2187 nt, Artificial Sequence
  derived and/or modified CDS sequence (opt8) from Homo sapiens__NP_000592.3__HsHGF
augugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaa

SEQ ID NO: 1759 - RNA, 1993 nt, Artificial Sequence
  derived and/or modified CDS sequence (opt8) from Mus musculus__NP_001276387.1__MmHGF
augauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcag

SEQ ID NO: 1760 - RNA, 618 nt, Artificial Sequence
  derived and/or modified CDS sequence (opt8) from Homo sapiens__NP_005253.3__HsGFER
auggccgcacccggcgaacgcggccgauuccacggcggaaacuuauucuuccucccaggcggcgcacgcuccgaaaugauggacgaccuagcaaccgacgcccgcggacgaggcgccggccgacgcgacgcagccgcaucagccagcacacccgcacaagccccaaccagcgacuccccagucgccgaagacgccucacgccgacgccccugcagagccugcgucgacuucaaaaccuggaugcgcacccaacaaaaacgcgacacaaaauucagagaagacugcccacccgaccgcgaagaacuaggcagacacucaugggccguccuccacacccuagccgccuacuaccccgaccuacccacccccgaacaacaacaagacauggcacaauucauacaccuauucuccaaauucuacccaugcgaagaaugcgccgaagaccuccgaaaacgacucugccgcaaccaccccgacacccgaacacgcgcaugcuucacccaauggcuaugccaccuacacaacgaaguaaaccgaaaacuaggaaaacccgacuucgacugcagcaaagucgacgaacgauggcgagacggcuggaaagacggauccugcgacuaa

SEQ ID NO: 1761 - RNA, 630 nt, Artificial Sequence
  derived and/or modified CDS sequence (opt9) from Homo sapiens__NP_061986.1__HsFGF21(L126R,P199G,A208E)
auggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaa

SEQ ID NO: 1762 - RNA, 2187 nt, Artificial Sequence
  derived and/or modified CDS sequence (opt9) from Homo sapiens__NP_000592.3__HsHGF
augugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcuga

SEQ ID NO: 1763 - RNA, 2187 nt, Artificial Sequence
  derived and/or modified CDS sequence (opt9) from Mus musculus__NP_001276387.1__MmHGF
augauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaa

SEQ ID NO: 1764 - RNA, 618 nt, Artificial Sequence
  derived and/or modified CDS sequence (opt9) from Homo sapiens__NP_005253.3__HsGFER
auggcagcacccggcgaacgcggacgauuccacggcggcaaccucuucuuccuccccggcggcgccagauccgaaaugauggacgaccuagccacagacgccagaggccgaggcgccggaagacgcgacgcagccgccagcgcaagcacacccgcccaagcccccaccagcgacagcccaguagcagaagacgccucacgccgccgacccugccgagcaugcgucgacuucaaaaccuggaugagaacccaacaaaaacgcgacaccaaauucagagaagacugcccacccgaccgcgaagaacucggccgacacucaugggcaguccuacacacacucgcagccuacuacccagaccuccccacacccgaacaacaacaagacauggcccaauucauccaccucuucagcaaauucuacccaugcgaagaaugcgcagaagaucucagaaaacggcucugccgcaaccacccagacacccgcacccgcgccugcuucacccaauggcucugccaccuccacaacgaaguaaaccgaaaacucggaaaacccgacuucgacugcagcaaagucgacgaacgauggcgagacggcuggaaagacggaagcugcgacuaa

SEQ ID NO: 1765 - RNA, 630 nt, Artificial Sequence
  derived and/or modified CDS sequence (opt11) from Homo sapiens__NP_061986.1__HsFGF21(L126R,P199G,A208E)
auggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaa

SEQ ID NO: 1766 - RNA, 2187 nt, Artificial Sequence
  derived and/or modified CDS sequence (opt11) from Homo sapiens__NP_000592.3__HsHGF
augugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaa

SEQ ID NO: 1767 - RNA, 2187 nt, Artificial Sequence
  derived and/or modified CDS sequence (opt11) from Mus musculus__NP_001276387.1__MmHGF
augauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaa

SEQ ID NO: 1768 - RNA, 618 nt, Artificial Sequence
  derived and/or modified CDS sequence (opt11) from Homo sapiens__NP_005253.3__HsGFER
auggcagcaccaggcgaacgcggacgcuuccacggaggcaaccuauucuuccuacccggaggcgcacgcucagaaaugauggacgaccuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacacucgcggccuacuacccagaccuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaauggcuaugccaccuacacaacgaaguaaaccgcaaacucggaaaaccagacuucgacugcagcaaagucgacgaaagguggagagacggauggaaagacggaagcugcgacuaa

SEQ ID NO: 1769 - RNA, 630 nt, Artificial Sequence
  derived and/or modified CDS sequence (opt12) from Homo sapiens__NP_061986.1__HsFGF21(L126R,P199G,A208E)
auggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaa

SEQ ID NO: 1770 - RNA, 2187 nt, Artificial Sequence
  derived and/or modified CDS sequence (opt12) from Homo sapiens__NP_000592.3__HsHGF
auguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaa

SEQ ID NO: 1771 - RNA, 2187 nt, Artificial Sequence
  derived and/or modified CDS sequence (opt12) from Mus musculus__NP_001276387.1__MmHGF
augauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaa

SEQ ID NO: 1772 - RNA, 618 nt, Artificial Sequence
  derived and/or modified CDS sequence (opt12) from Homo sapiens__NP_005253.3__HsGFER
auggcugcaccaggagaaagaggaagauuucauggaggaaauuuauucuuuuuaccaggaggagcaagaagugaaaugauggaugauuuagcaacagaugcaagaggaagaggagcaggaagaagagaugcagcagcaagugcaaguacaccagcacaagcaccaacaagugauaguccaguagcagaagaugcaaguagaagaagaccauguagagcauguguagauuuuaaaacauggaugagaacacaacaaaagagagauacaaaauuuagagaagauuguccaccagauagagaagaacuaggaagacauaguugggcaguacuacauacacuagcagcauauuauccagauuuaccaacaccagaacaacaacaagauauggcacaauuuauacauuuauuuaguaaauuuuacccaugugaagaaugugcggaagauuuaagaaaaagauuauguagaaaucauccagauacaagaacaagagcauguuuuacucaaugguuaugucauuuacauaaugaaguaaauagaaaauuaggaaaaccagauuuugauuguaguaaaguagaugaaagauggagagacggauggaaagauggaaguugugauuaa

SEQ ID NO: 1773 - RNA, 630 nt, Artificial Sequence
  derived and/or modified CDS sequence (opt13) from Homo sapiens__NP_061986.1__HsFGF21(L126R,P199G,A208E)
auggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaa

SEQ ID NO: 1774 - RNA, 2187 nt, Artificial Sequence
  derived and/or modified CDS sequence (opt13) from Homo sapiens__NP_000592.3__HsHGF
auguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaa

SEQ ID NO: 1775 - RNA, 2187 nt, Artificial Sequence
  derived and/or modified CDS sequence (opt13) from Mus musculus__NP_001276387.1__MmHGF
augauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaa

SEQ ID NO: 1776 - RNA, 618 nt, Artificial Sequence
  derived and/or modified CDS sequence (opt13) from Homo sapiens__NP_005253.3__HsGFER
auggcggcaccaggagaaagaggaagauuucaugguggaaauuuauucuuuuuaccaggaggagcaagaucagaaaugauggaugacuuagcaacggaugcaagaggaagaggagcaggaagaagagaugcagcagcaucagcaucaacaccagcacaagcaccaacaagcgauaguccaguagcagaagaugcaagcagaagaagaccauguagagcauguguagauuuuaaaacauggaugagaacacaacaaaaacgagacacaaaauuuagagaagauuguccaccagauagagaagaauuaggaagacacucaugggcaguauuacauacauuagcagcauauuauccagaucuaccaacaccagaacaacaacaagauauggcacaauuuauacauuuauuuucaaaauuuuauccaugugaagaaugugcagaagaucuaagaaaaagacuauguagaaaucauccagauacaagaacaagagcauguuuuacacaaugguuaugucacuuacacaacgaaguaaauagaaaauuaggaaaaccagauuuugauuguaguaaaguagaugaaagauggagagauggauggaaagauggaaguugugauuaa

SEQ ID NO: 1777 - RNA, 847 nt, Artificial Sequence
  mRNA product Design1 comprising derived and/or modified sequence from Homo sapiens__NP_061986.1__HsFGF21(L126R,P199G,A208E) (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1778 - RNA, 847 nt, Artificial Sequence
  mRNA product Design1 comprising derived and/or modified sequence from Homo sapiens__NP_061986.1__HsFGF21(L126R,P199G,A208E) (wt)
gggagaaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1779 - RNA, 2404 nt, Artificial Sequence
  mRNA product Design1 comprising derived and/or modified sequence from Homo sapiens__NP_000592.3__HsHGF (wt)
gggagaaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1780 - RNA, 2404 nt, Artificial Sequence
  mRNA product Design1 comprising derived and/or modified sequence from Homo sapiens__NP_000592.3__HsHGF (wt)
gggagaaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1781 - RNA, 2404 nt, Artificial Sequence
  mRNA product Design1 comprising derived and/or modified sequence from Mus musculus__NP_001276387.1__MmHGF (wt)
gggagaaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1782 - RNA, 2404 nt, Artificial Sequence
  mRNA product Design1 comprising derived and/or modified sequence from Mus musculus__NP_001276387.1__MmHGF (wt)
gggagaaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1783 - RNA, 835 nt, Artificial Sequence
  mRNA product Design1 comprising derived and/or modified sequence from Homo sapiens__NP_005253.3__HsGFER (wt)
gggagaaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccugcacaaugaagugaaccgcaagcugggcaagccugacuucgacugcucaaaaguggaugagcgcuggcgcgacggcuggaaggauggcuccugugacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1784 - RNA, 835 nt, Artificial Sequence
  mRNA product Design1 comprising derived and/or modified sequence from Homo sapiens__NP_005253.3__HsGFER (wt)
gggagaaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccuccacaaugaagugaaccgcaagcugggcaagccugacuucgacugcucaaaaguggaugagcgcuggcgcgacggcuggaaggauggcuccugugacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1785 - RNA, 847 nt, Artificial Sequence
  mRNA product Design1 comprising derived and/or modified sequence from Homo sapiens__NP_061986.1__HsFGF21(L126R,P199G,A208E) (opt1)
gggagaaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1786 - RNA, 2404 nt, Artificial Sequence
  mRNA product Design1 comprising derived and/or modified sequence from Homo sapiens__NP_000592.3__HsHGF (opt1)
gggagaaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1787 - RNA, 2404 nt, Artificial Sequence
  mRNA product Design1 comprising derived and/or modified sequence from Mus musculus__NP_001276387.1__MmHGF (opt1)
gggagaaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1788 - RNA, 835 nt, Artificial Sequence
  mRNA product Design1 comprising derived and/or modified sequence from Homo sapiens__NP_005253.3__HsGFER (opt1)
gggagaaagcuuaccauggccgcccccggcgagcgcgggcgguuccacggcgggaaccuguucuuccugccgggcggggcgcgcagcgagaugauggacgaccuggccaccgacgcccggggccgcggcgccgggcggcgcgacgccgcggccuccgccagcacccccgcccaggcgcccacguccgacagccccguggccgaggacgccucccggcgccggccgugccgcgccugcgucgacuucaagaccuggaugcggacccagcagaagcgcgacaccaaguuccgggaggacugcccgcccgaccgcgaggagcugggccggcacagcugggccgugcuccacacgcuggcggccuacuaccccgaccugcccacccccgagcagcagcaggacauggcccaguucauccaccucuucuccaaguucuaccccugcgaggagugcgccgaggaccugcgcaagcggcugugccgcaaccaccccgacacccggacccgcgccugcuucacgcaguggcucugccaccuccacaacgaggugaaccggaagcuggggaagccggacuucgacugcagcaaggucgacgagcgcuggcgcgacggcuggaaggacggguccugcgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1789 - RNA, 847 nt, Artificial Sequence
  mRNA product Design1 comprising derived and/or modified sequence from Homo sapiens__NP_061986.1__HsFGF21(L126R,P199G,A208E) (opt2)
gggagaaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1790 - RNA, 2404 nt, Artificial Sequence
  mRNA product Design1 comprising derived and/or modified sequence from Homo sapiens__NP_000592.3__HsHGF (opt2)
gggagaaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1791 - RNA, 2404 nt, Artificial Sequence
  mRNA product Design1 comprising derived and/or modified sequence from Mus musculus__NP_001276387.1__MmHGF (opt2)
gggagaaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1792 - RNA, 835 nt, Artificial Sequence
  mRNA product Design1 comprising derived and/or modified sequence from Homo sapiens__NP_005253.3__HsGFER (opt2)
gggagaaagcuuaccauggccgcccccggcgagcgcggccgcuuccacggcggcaaccucuucuuccuccccggcggcgcccgcuccgagaugauggacgaccucgccaccgacgcccgcggccgcggcgccggccgccgcgacgccgccgccuccgccuccacccccgcccaggcccccaccuccgacucccccgucgccgaggacgccucccgccgccgccccugccgcgccugcgucgacuucaagaccuggaugcgcacccagcagaagcgcgacaccaaguuccgcgaggacugcccccccgaccgcgaggagcucggccgccacuccugggccguccuccacacccucgccgccuacuaccccgaccuccccacccccgagcagcagcaggacauggcccaguucauccaccucuucuccaaguucuaccccugcgaggagugcgccgaggaccuccgcaagcgccucugccgcaaccaccccgacacccgcacccgcgccugcuucacccaguggcucugccaccuccacaacgaggucaaccgcaagcucggcaagcccgacuucgacugcuccaaggucgacgagcgcuggcgcgacggcuggaaggacggcuccugcgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1793 - RNA, 847 nt, Artificial Sequence
  mRNA product Design1 comprising derived and/or modified sequence from Homo sapiens__NP_061986.1__HsFGF21(L126R,P199G,A208E) (opt3)
gggagaaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1794 - RNA, 2404 nt, Artificial Sequence
  mRNA product Design1 comprising derived and/or modified sequence from Homo sapiens__NP_000592.3__HsHGF (opt3)
gggagaaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1795 - RNA, 2404 nt, Artificial Sequence
  mRNA product Design1 comprising derived and/or modified sequence from Mus musculus__NP_001276387.1__MmHGF (opt3)
gggagaaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1796 - RNA, 835 nt, Artificial Sequence
  mRNA product Design1 comprising derived and/or modified sequence from Homo sapiens__NP_005253.3__HsGFER (opt3)
gggagaaagcuuaccauggccgcucccggcgagagagggagguuccacggagguaaccuguuuuuccucccuggcggggcacggagcgaaaugauggacgaucuugccaccgacgcgcgcggacgaggcgcuggucguagagaugccgcagccuccgcuucuacaccagcacaggccccgacuucagacagucccguggcugaggaugccagcaggcggcgcccuugcagagcgugugucgacuuuaagacguggaugaggacccaacagaaacgggauacaaaguuccgcgaagacugcccacccgaucgagaggaacuggggagacauuccugggcaguuuugcacacuuuagccgcuuacuauccugaccugccaacccccgagcagcagcaagauauggcccaguuuauccaucuauucucuaaauuuuacccuugugaggaaugcgcagaggaccucaggaagcggcugugucguaaucacccagauacacgcaccagagcuugcuucacucaguggcuuugucaucugcacaacgaagugaauaggaaauugggaaagccggacuuugacugcucgaagguagaugagcgguggcgagacggcuggaaagauggcucaugugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1797 - RNA, 847 nt, Artificial Sequence
  mRNA product Design1 comprising derived and/or modified sequence from Homo sapiens__NP_061986.1__HsFGF21(L126R,P199G,A208E) (opt4)
gggagaaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1798 - RNA, 2404 nt, Artificial Sequence
  mRNA product Design1 comprising derived and/or modified sequence from Homo sapiens__NP_000592.3__HsHGF (opt4)
gggagaaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1799 - RNA, 2404 nt, Artificial Sequence
  mRNA product Design1 comprising derived and/or modified sequence from Mus musculus__NP_001276387.1__MmHGF (opt4)
gggagaaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1800 - RNA, 835 nt, Artificial Sequence
  mRNA product Design1 comprising derived and/or modified sequence from Homo sapiens__NP_005253.3__HsGFER (opt4)
gggagaaagcuuaccauggccgcccccggcgagagaggcagauuccacggcggcaaccuguucuuccugcccggcggcgccagaagcgagaugauggacgaccuggccaccgacgccagaggcagaggcgccggcagaagagacgccgccgccagcgccagcacccccgcccaggcccccaccagcgacagccccguggccgaggacgccagcagaagaagacccugcagagccugcguggacuucaagaccuggaugagaacccagcagaagagagacaccaaguucagagaggacugcccccccgacagagaggagcugggcagacacagcugggccgugcugcacacccuggccgccuacuaccccgaccugcccacccccgagcagcagcaggacauggcccaguucauccaccuguucagcaaguucuaccccugcgaggagugcgccgaggaccugagaaagagacugugcagaaaccaccccgacaccagaaccagagccugcuucacccaguggcugugccaccugcacaacgaggugaacagaaagcugggcaagcccgacuucgacugcagcaagguggacgagagauggagagacggcuggaaggacggcagcugcgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1801 - RNA, 847 nt, Artificial Sequence
  mRNA product Design1 comprising derived and/or modified sequence from Homo sapiens__NP_061986.1__HsFGF21(L126R,P199G,A208E) (opt5)
gggagaaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1802 - RNA, 2404 nt, Artificial Sequence
  mRNA product Design1 comprising derived and/or modified sequence from Homo sapiens__NP_000592.3__HsHGF (opt5)
gggagaaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1803 - RNA, 2404 nt, Artificial Sequence
  mRNA product Design1 comprising derived and/or modified sequence from Mus musculus__NP_001276387.1__MmHGF (opt5)
gggagaaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1804 - RNA, 835 nt, Artificial Sequence
  mRNA product Design1 comprising derived and/or modified sequence from Homo sapiens__NP_005253.3__HsGFER (opt5)
gggagaaagcuuaccauggccgcucccggcgagagagggcgguuccacggaggcaaccuguuuuuccucccugggggagcccgcagcgaaaugauggacgaucuggcgaccgacgcuagaggccgcggggccggacggagagaugccgcugccuccgcuucuacaccggcccaggcgcccacgagcgacuccccuguggccgaggaugcuucucggcgcagacccugccgggccugugucgacuuuaagaccuggaugcgcacacaacagaaaagagauaccaaguuccgggaagacugcccucccgaucgcgaggaacuuggcagacauagcugggcuguucugcacacacucgccgcguacuauccugaccugccgacccccgagcagcagcaagauauggcccaguuuauccaucuuuucuccaaauuuuacccuugugaggaaugcgcugaggaccugcggaagcgccucuguagaaaucaccccgauacacggaccagagccugcuucacgcaguggcugugucaucugcacaacgaagugaaucgcaaacucggcaagccugacuuugacugcucuaagguggaugagcgguggagagacggguggaaagauggaagcugugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1805 - RNA, 847 nt, Artificial Sequence
  mRNA product Design1 comprising derived and/or modified sequence from Homo sapiens__NP_061986.1__HsFGF21(L126R,P199G,A208E) (opt6)
gggagaaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1806 - RNA, 2404 nt, Artificial Sequence
  mRNA product Design1 comprising derived and/or modified sequence from Homo sapiens__NP_000592.3__HsHGF (opt6)
gggagaaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1807 - RNA, 2404 nt, Artificial Sequence
  mRNA product Design1 comprising derived and/or modified sequence from Mus musculus__NP_001276387.1__MmHGF (opt6)
gggagaaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1808 - RNA, 835 nt, Artificial Sequence
  mRNA product Design1 comprising derived and/or modified sequence from Homo sapiens__NP_005253.3__HsGFER (opt6)
gggagaaagcuuaccauggcagcaccaggagaaagaggaagauuucaugggggaaauuuauuuuuucuaccaggaggugcaagaagugaaaugauggaugaucuggcaacagaugcaagaggaagaggagcaggaagaagagaugcagcagcaagcgcaaguacaccagcacaagcaccaacaagugauaguccaguagcagaagaugcaaguagaagaagaccauguagagcauguguagauuuuaaaacauggaugagaacacaacaaaaaagagauacaaaauuuagagaagacuguccaccagacagagaagaauuaggaagacauucaugggcaguauuacauacauuagcagcauauuauccagaucuaccaacgccagaacaacaacaagauauggcacaauuuauacauuuauuuaguaaauuuuauccaugugaagaaugugcagaagauuuaagaaaaagacuuuguagaaaucauccagauacaagaacaagagcauguuuuacacaaugguuaugucauuuacauaaugaaguaaauagaaaauuaggaaaaccagauuuugauuguagcaaaguagaugaaagauggagagauggauggaaagauggaaguugugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1809 - RNA, 847 nt, Artificial Sequence
  mRNA product Design1 comprising derived and/or modified sequence from Homo sapiens__NP_061986.1__HsFGF21(L126R,P199G,A208E) (opt7)
gggagaaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1810 - RNA, 2404 nt, Artificial Sequence
  mRNA product Design1 comprising derived and/or modified sequence from Homo sapiens__NP_000592.3__HsHGF (opt7)
gggagaaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1811 - RNA, 2404 nt, Artificial Sequence
  mRNA product Design1 comprising derived and/or modified sequence from Mus musculus__NP_001276387.1__MmHGF (opt7)
gggagaaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1812 - RNA, 835 nt, Artificial Sequence
  mRNA product Design1 comprising derived and/or modified sequence from Homo sapiens__NP_005253.3__HsGFER (opt7)
gggagaaagcuuaccauggccgcacccggcgagagggggcgguuccacgguggcaaccuguuuuuccucccagggggcgcccgcagcgaaaugauggacgaucuggcgaccgacgccaggggucgcggggcaggccggagggaugccgcagccuccgcgaguacuccggcccaggcacccaccagcgacuccccaguggccgaggaugccagucggcgcaggcccugccgggcaugugucgacuuuaagacguggaugcgcacucaacagaaaagggauaccaaguuccgggaagacugcccacccgaucgcgaggaauugggcaggcauagcugggccgugcugcacacccucgcggccuacuauccagaccugccgacucccgagcagcagcaagauauggcacaguuuauccauuuguucuccaaauuuuacccaugugaggaaugcgccgaggaccugcggaagcgccucuguaggaaucaccccgauacccggacgcgcgcaugcuucacucaguggcugugucaucugcacaacgaaguaaauaggaaacucgggaagccagacuuugacugcagcaagguggaugagcgguggagggacgguuggaaagauggcuccugugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1813 - RNA, 847 nt, Artificial Sequence
  mRNA product Design1 comprising derived and/or modified sequence from Homo sapiens__NP_061986.1__HsFGF21(L126R,P199G,A208E) (opt8)
gggagaaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1814 - RNA, 2404 nt, Artificial Sequence
  mRNA product Design1 comprising derived and/or modified sequence from Homo sapiens__NP_000592.3__HsHGF (opt8)
gggagaaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1815 - RNA, 2210 nt, Artificial Sequence
  mRNA product Design1 comprising derived and/or modified sequence from Mus musculus__NP_001276387.1__MmHGF (opt8)
gggagaaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1816 - RNA, 835 nt, Artificial Sequence
  mRNA product Design1 comprising derived and/or modified sequence from Homo sapiens__NP_005253.3__HsGFER (opt8)
gggagaaagcuuaccauggccgcacccggcgaacgcggccgauuccacggcggaaacuuauucuuccucccaggcggcgcacgcuccgaaaugauggacgaccuagcaaccgacgcccgcggacgaggcgccggccgacgcgacgcagccgcaucagccagcacacccgcacaagccccaaccagcgacuccccagucgccgaagacgccucacgccgacgccccugcagagccugcgucgacuucaaaaccuggaugcgcacccaacaaaaacgcgacacaaaauucagagaagacugcccacccgaccgcgaagaacuaggcagacacucaugggccguccuccacacccuagccgccuacuaccccgaccuacccacccccgaacaacaacaagacauggcacaauucauacaccuauucuccaaauucuacccaugcgaagaaugcgccgaagaccuccgaaaacgacucugccgcaaccaccccgacacccgaacacgcgcaugcuucacccaauggcuaugccaccuacacaacgaaguaaaccgaaaacuaggaaaacccgacuucgacugcagcaaagucgacgaacgauggcgagacggcuggaaagacggauccugcgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1817 - RNA, 847 nt, Artificial Sequence
  mRNA product Design1 comprising derived and/or modified sequence from Homo sapiens__NP_061986.1__HsFGF21(L126R,P199G,A208E) (opt9)
gggagaaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1818 - RNA, 2404 nt, Artificial Sequence
  mRNA product Design1 comprising derived and/or modified sequence from Homo sapiens__NP_000592.3__HsHGF (opt9)
gggagaaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1819 - RNA, 2404 nt, Artificial Sequence
  mRNA product Design1 comprising derived and/or modified sequence from Mus musculus__NP_001276387.1__MmHGF (opt9)
gggagaaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1820 - RNA, 835 nt, Artificial Sequence
  mRNA product Design1 comprising derived and/or modified sequence from Homo sapiens__NP_005253.3__HsGFER (opt9)
gggagaaagcuuaccauggcagcacccggcgaacgcggacgauuccacggcggcaaccucuucuuccuccccggcggcgccagauccgaaaugauggacgaccuagccacagacgccagaggccgaggcgccggaagacgcgacgcagccgccagcgcaagcacacccgcccaagcccccaccagcgacagcccaguagcagaagacgccucacgccgccgacccugccgagcaugcgucgacuucaaaaccuggaugagaacccaacaaaaacgcgacaccaaauucagagaagacugcccacccgaccgcgaagaacucggccgacacucaugggcaguccuacacacacucgcagccuacuacccagaccuccccacacccgaacaacaacaagacauggcccaauucauccaccucuucagcaaauucuacccaugcgaagaaugcgcagaagaucucagaaaacggcucugccgcaaccacccagacacccgcacccgcgccugcuucacccaauggcucugccaccuccacaacgaaguaaaccgaaaacucggaaaacccgacuucgacugcagcaaagucgacgaacgauggcgagacggcuggaaagacggaagcugcgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1821 - RNA, 847 nt, Artificial Sequence
  mRNA product Design1 comprising derived and/or modified sequence from Homo sapiens__NP_061986.1__HsFGF21(L126R,P199G,A208E) (opt11)
gggagaaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1822 - RNA, 2404 nt, Artificial Sequence
  mRNA product Design1 comprising derived and/or modified sequence from Homo sapiens__NP_000592.3__HsHGF (opt11)
gggagaaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1823 - RNA, 2404 nt, Artificial Sequence
  mRNA product Design1 comprising derived and/or modified sequence from Mus musculus__NP_001276387.1__MmHGF (opt11)
gggagaaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1824 - RNA, 835 nt, Artificial Sequence
  mRNA product Design1 comprising derived and/or modified sequence from Homo sapiens__NP_005253.3__HsGFER (opt11)
gggagaaagcuuaccauggcagcaccaggcgaacgcggacgcuuccacggaggcaaccuauucuuccuacccggaggcgcacgcucagaaaugauggacgaccuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacacucgcggccuacuacccagaccuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaauggcuaugccaccuacacaacgaaguaaaccgcaaacucggaaaaccagacuucgacugcagcaaagucgacgaaagguggagagacggauggaaagacggaagcugcgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1825 - RNA, 847 nt, Artificial Sequence
  mRNA product Design1 comprising derived and/or modified sequence from Homo sapiens__NP_061986.1__HsFGF21(L126R,P199G,A208E) (opt12)
gggagaaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1826 - RNA, 2404 nt, Artificial Sequence
  mRNA product Design1 comprising derived and/or modified sequence from Homo sapiens__NP_000592.3__HsHGF (opt12)
gggagaaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1827 - RNA, 2404 nt, Artificial Sequence
  mRNA product Design1 comprising derived and/or modified sequence from Mus musculus__NP_001276387.1__MmHGF (opt12)
gggagaaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1828 - RNA, 835 nt, Artificial Sequence
  mRNA product Design1 comprising derived and/or modified sequence from Homo sapiens__NP_005253.3__HsGFER (opt12)
gggagaaagcuuaccauggcugcaccaggagaaagaggaagauuucauggaggaaauuuauucuuuuuaccaggaggagcaagaagugaaaugauggaugauuuagcaacagaugcaagaggaagaggagcaggaagaagagaugcagcagcaagugcaaguacaccagcacaagcaccaacaagugauaguccaguagcagaagaugcaaguagaagaagaccauguagagcauguguagauuuuaaaacauggaugagaacacaacaaaagagagauacaaaauuuagagaagauuguccaccagauagagaagaacuaggaagacauaguugggcaguacuacauacacuagcagcauauuauccagauuuaccaacaccagaacaacaacaagauauggcacaauuuauacauuuauuuaguaaauuuuacccaugugaagaaugugcggaagauuuaagaaaaagauuauguagaaaucauccagauacaagaacaagagcauguuuuacucaaugguuaugucauuuacauaaugaaguaaauagaaaauuaggaaaaccagauuuugauuguaguaaaguagaugaaagauggagagacggauggaaagauggaaguugugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1829 - RNA, 847 nt, Artificial Sequence
  mRNA product Design1 comprising derived and/or modified sequence from Homo sapiens__NP_061986.1__HsFGF21(L126R,P199G,A208E) (opt13)
gggagaaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1830 - RNA, 2404 nt, Artificial Sequence
  mRNA product Design1 comprising derived and/or modified sequence from Homo sapiens__NP_000592.3__HsHGF (opt13)
gggagaaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1831 - RNA, 2404 nt, Artificial Sequence
  mRNA product Design1 comprising derived and/or modified sequence from Mus musculus__NP_001276387.1__MmHGF (opt13)
gggagaaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1832 - RNA, 835 nt, Artificial Sequence
  mRNA product Design1 comprising derived and/or modified sequence from Homo sapiens__NP_005253.3__HsGFER (opt13)
gggagaaagcuuaccauggcggcaccaggagaaagaggaagauuucaugguggaaauuuauucuuuuuaccaggaggagcaagaucagaaaugauggaugacuuagcaacggaugcaagaggaagaggagcaggaagaagagaugcagcagcaucagcaucaacaccagcacaagcaccaacaagcgauaguccaguagcagaagaugcaagcagaagaagaccauguagagcauguguagauuuuaaaacauggaugagaacacaacaaaaacgagacacaaaauuuagagaagauuguccaccagauagagaagaauuaggaagacacucaugggcaguauuacauacauuagcagcauauuauccagaucuaccaacaccagaacaacaacaagauauggcacaauuuauacauuuauuuucaaaauuuuauccaugugaagaaugugcagaagaucuaagaaaaagacuauguagaaaucauccagauacaagaacaagagcauguuuuacacaaugguuaugucacuuacacaacgaaguaaauagaaaauuaggaaaaccagauuuugauuguaguaaaguagaugaaagauggagagauggauggaaagauggaaguugugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1833 - RNA, 1012 nt, Artificial Sequence
  mRNA product Design2 comprising derived and/or modified sequence from Homo sapiens__NP_061986.1__HsFGF21(L126R,P199G,A208E) (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1834 - RNA, 1012 nt, Artificial Sequence
  mRNA product Design2 comprising derived and/or modified sequence from Homo sapiens__NP_061986.1__HsFGF21(L126R,P199G,A208E) (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1835 - RNA, 2569 nt, Artificial Sequence
  mRNA product Design2 comprising derived and/or modified sequence from Homo sapiens__NP_000592.3__HsHGF (wt)
ggggcgcugccuacggagguggcagccaucuccuucucggcaucaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1836 - RNA, 2569 nt, Artificial Sequence
  mRNA product Design2 comprising derived and/or modified sequence from Homo sapiens__NP_000592.3__HsHGF (wt)
ggggcgcugccuacggagguggcagccaucuccuucucggcaucaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1837 - RNA, 2569 nt, Artificial Sequence
  mRNA product Design2 comprising derived and/or modified sequence from Mus musculus__NP_001276387.1__MmHGF (wt)
ggggcgcugccuacggagguggcagccaucuccuucucggcaucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1838 - RNA, 2569 nt, Artificial Sequence
  mRNA product Design2 comprising derived and/or modified sequence from Mus musculus__NP_001276387.1__MmHGF (wt)
ggggcgcugccuacggagguggcagccaucuccuucucggcaucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1839 - RNA, 1000 nt, Artificial Sequence
  mRNA product Design2 comprising derived and/or modified sequence from Homo sapiens__NP_005253.3__HsGFER (wt)
ggggcgcugccuacggagguggcagccaucuccuucucggcaucaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccugcacaaugaagugaaccgcaagcugggcaagccugacuucgacugcucaaaaguggaugagcgcuggcgcgacggcuggaaggauggcuccugugacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1840 - RNA, 1000 nt, Artificial Sequence
  mRNA product Design2 comprising derived and/or modified sequence from Homo sapiens__NP_005253.3__HsGFER (wt)
ggggcgcugccuacggagguggcagccaucuccuucucggcaucaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccuccacaaugaagugaaccgcaagcugggcaagccugacuucgacugcucaaaaguggaugagcgcuggcgcgacggcuggaaggauggcuccugugacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1841 - RNA, 1012 nt, Artificial Sequence
  mRNA product Design2 comprising derived and/or modified sequence from Homo sapiens__NP_061986.1__HsFGF21(L126R,P199G,A208E) (opt1)
ggggcgcugccuacggagguggcagccaucuccuucucggcaucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1842 - RNA, 2569 nt, Artificial Sequence
  mRNA product Design2 comprising derived and/or modified sequence from Homo sapiens__NP_000592.3__HsHGF (opt1) R4607
ggggcgcugccuacggagguggcagccaucuccuucucggcaucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1843 - RNA, 2569 nt, Artificial Sequence
  mRNA product Design2 comprising derived and/or modified sequence from Mus musculus__NP_001276387.1__MmHGF (opt1) R4603
ggggcgcugccuacggagguggcagccaucuccuucucggcaucaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1844 - RNA, 1000 nt, Artificial Sequence
  mRNA product Design2 comprising derived and/or modified sequence from Homo sapiens__NP_005253.3__HsGFER (opt1)
ggggcgcugccuacggagguggcagccaucuccuucucggcaucaagcuuaccauggccgcccccggcgagcgcgggcgguuccacggcgggaaccuguucuuccugccgggcggggcgcgcagcgagaugauggacgaccuggccaccgacgcccggggccgcggcgccgggcggcgcgacgccgcggccuccgccagcacccccgcccaggcgcccacguccgacagccccguggccgaggacgccucccggcgccggccgugccgcgccugcgucgacuucaagaccuggaugcggacccagcagaagcgcgacaccaaguuccgggaggacugcccgcccgaccgcgaggagcugggccggcacagcugggccgugcuccacacgcuggcggccuacuaccccgaccugcccacccccgagcagcagcaggacauggcccaguucauccaccucuucuccaaguucuaccccugcgaggagugcgccgaggaccugcgcaagcggcugugccgcaaccaccccgacacccggacccgcgccugcuucacgcaguggcucugccaccuccacaacgaggugaaccggaagcuggggaagccggacuucgacugcagcaaggucgacgagcgcuggcgcgacggcuggaaggacggguccugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1845 - RNA, 1012 nt, Artificial Sequence
  mRNA product Design2 comprising derived and/or modified sequence from Homo sapiens__NP_061986.1__HsFGF21(L126R,P199G,A208E) (opt2)
ggggcgcugccuacggagguggcagccaucuccuucucggcaucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1846 - RNA, 2569 nt, Artificial Sequence
  mRNA product Design2 comprising derived and/or modified sequence from Homo sapiens__NP_000592.3__HsHGF (opt2)
ggggcgcugccuacggagguggcagccaucuccuucucggcaucaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1847 - RNA, 2569 nt, Artificial Sequence
  mRNA product Design2 comprising derived and/or modified sequence from Mus musculus__NP_001276387.1__MmHGF (opt2)
ggggcgcugccuacggagguggcagccaucuccuucucggcaucaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1848 - RNA, 1000 nt, Artificial Sequence
  mRNA product Design2 comprising derived and/or modified sequence from Homo sapiens__NP_005253.3__HsGFER (opt2)
ggggcgcugccuacggagguggcagccaucuccuucucggcaucaagcuuaccauggccgcccccggcgagcgcggccgcuuccacggcggcaaccucuucuuccuccccggcggcgcccgcuccgagaugauggacgaccucgccaccgacgcccgcggccgcggcgccggccgccgcgacgccgccgccuccgccuccacccccgcccaggcccccaccuccgacucccccgucgccgaggacgccucccgccgccgccccugccgcgccugcgucgacuucaagaccuggaugcgcacccagcagaagcgcgacaccaaguuccgcgaggacugcccccccgaccgcgaggagcucggccgccacuccugggccguccuccacacccucgccgccuacuaccccgaccuccccacccccgagcagcagcaggacauggcccaguucauccaccucuucuccaaguucuaccccugcgaggagugcgccgaggaccuccgcaagcgccucugccgcaaccaccccgacacccgcacccgcgccugcuucacccaguggcucugccaccuccacaacgaggucaaccgcaagcucggcaagcccgacuucgacugcuccaaggucgacgagcgcuggcgcgacggcuggaaggacggcuccugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1849 - RNA, 1012 nt, Artificial Sequence
  mRNA product Design2 comprising derived and/or modified sequence from Homo sapiens__NP_061986.1__HsFGF21(L126R,P199G,A208E) (opt3)
ggggcgcugccuacggagguggcagccaucuccuucucggcaucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1850 - RNA, 2569 nt, Artificial Sequence
  mRNA product Design2 comprising derived and/or modified sequence from Homo sapiens__NP_000592.3__HsHGF (opt3)
ggggcgcugccuacggagguggcagccaucuccuucucggcaucaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1851 - RNA, 2569 nt, Artificial Sequence
  mRNA product Design2 comprising derived and/or modified sequence from Mus musculus__NP_001276387.1__MmHGF (opt3)
ggggcgcugccuacggagguggcagccaucuccuucucggcaucaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1852 - RNA, 1000 nt, Artificial Sequence
  mRNA product Design2 comprising derived and/or modified sequence from Homo sapiens__NP_005253.3__HsGFER (opt3)
ggggcgcugccuacggagguggcagccaucuccuucucggcaucaagcuuaccauggccgcucccggcgagagagggagguuccacggagguaaccuguuuuuccucccuggcggggcacggagcgaaaugauggacgaucuugccaccgacgcgcgcggacgaggcgcuggucguagagaugccgcagccuccgcuucuacaccagcacaggccccgacuucagacagucccguggcugaggaugccagcaggcggcgcccuugcagagcgugugucgacuuuaagacguggaugaggacccaacagaaacgggauacaaaguuccgcgaagacugcccacccgaucgagaggaacuggggagacauuccugggcaguuuugcacacuuuagccgcuuacuauccugaccugccaacccccgagcagcagcaagauauggcccaguuuauccaucuauucucuaaauuuuacccuugugaggaaugcgcagaggaccucaggaagcggcugugucguaaucacccagauacacgcaccagagcuugcuucacucaguggcuuugucaucugcacaacgaagugaauaggaaauugggaaagccggacuuugacugcucgaagguagaugagcgguggcgagacggcuggaaagauggcucaugugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1853 - RNA, 1012 nt, Artificial Sequence
  mRNA product Design2 comprising derived and/or modified sequence from Homo sapiens__NP_061986.1__HsFGF21(L126R,P199G,A208E) (opt4)
ggggcgcugccuacggagguggcagccaucuccuucucggcaucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1854 - RNA, 2569 nt, Artificial Sequence
  mRNA product Design2 comprising derived and/or modified sequence from Homo sapiens__NP_000592.3__HsHGF (opt4)
ggggcgcugccuacggagguggcagccaucuccuucucggcaucaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1855 - RNA, 2569 nt, Artificial Sequence
  mRNA product Design2 comprising derived and/or modified sequence from Mus musculus__NP_001276387.1__MmHGF (opt4)
ggggcgcugccuacggagguggcagccaucuccuucucggcaucaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1856 - RNA, 1000 nt, Artificial Sequence
  mRNA product Design2 comprising derived and/or modified sequence from Homo sapiens__NP_005253.3__HsGFER (opt4)
ggggcgcugccuacggagguggcagccaucuccuucucggcaucaagcuuaccauggccgcccccggcgagagaggcagauuccacggcggcaaccuguucuuccugcccggcggcgccagaagcgagaugauggacgaccuggccaccgacgccagaggcagaggcgccggcagaagagacgccgccgccagcgccagcacccccgcccaggcccccaccagcgacagccccguggccgaggacgccagcagaagaagacccugcagagccugcguggacuucaagaccuggaugagaacccagcagaagagagacaccaaguucagagaggacugcccccccgacagagaggagcugggcagacacagcugggccgugcugcacacccuggccgccuacuaccccgaccugcccacccccgagcagcagcaggacauggcccaguucauccaccuguucagcaaguucuaccccugcgaggagugcgccgaggaccugagaaagagacugugcagaaaccaccccgacaccagaaccagagccugcuucacccaguggcugugccaccugcacaacgaggugaacagaaagcugggcaagcccgacuucgacugcagcaagguggacgagagauggagagacggcuggaaggacggcagcugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1857 - RNA, 1012 nt, Artificial Sequence
  mRNA product Design2 comprising derived and/or modified sequence from Homo sapiens__NP_061986.1__HsFGF21(L126R,P199G,A208E) (opt5)
ggggcgcugccuacggagguggcagccaucuccuucucggcaucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1858 - RNA, 2569 nt, Artificial Sequence
  mRNA product Design2 comprising derived and/or modified sequence from Homo sapiens__NP_000592.3__HsHGF (opt5)
ggggcgcugccuacggagguggcagccaucuccuucucggcaucaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1859 - RNA, 2569 nt, Artificial Sequence
  mRNA product Design2 comprising derived and/or modified sequence from Mus musculus__NP_001276387.1__MmHGF (opt5)
ggggcgcugccuacggagguggcagccaucuccuucucggcaucaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1860 - RNA, 1000 nt, Artificial Sequence
  mRNA product Design2 comprising derived and/or modified sequence from Homo sapiens__NP_005253.3__HsGFER (opt5)
ggggcgcugccuacggagguggcagccaucuccuucucggcaucaagcuuaccauggccgcucccggcgagagagggcgguuccacggaggcaaccuguuuuuccucccugggggagcccgcagcgaaaugauggacgaucuggcgaccgacgcuagaggccgcggggccggacggagagaugccgcugccuccgcuucuacaccggcccaggcgcccacgagcgacuccccuguggccgaggaugcuucucggcgcagacccugccgggccugugucgacuuuaagaccuggaugcgcacacaacagaaaagagauaccaaguuccgggaagacugcccucccgaucgcgaggaacuuggcagacauagcugggcuguucugcacacacucgccgcguacuauccugaccugccgacccccgagcagcagcaagauauggcccaguuuauccaucuuuucuccaaauuuuacccuugugaggaaugcgcugaggaccugcggaagcgccucuguagaaaucaccccgauacacggaccagagccugcuucacgcaguggcugugucaucugcacaacgaagugaaucgcaaacucggcaagccugacuuugacugcucuaagguggaugagcgguggagagacggguggaaagauggaagcugugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1861 - RNA, 1012 nt, Artificial Sequence
  mRNA product Design2 comprising derived and/or modified sequence from Homo sapiens__NP_061986.1__HsFGF21(L126R,P199G,A208E) (opt6)
ggggcgcugccuacggagguggcagccaucuccuucucggcaucaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1862 - RNA, 2569 nt, Artificial Sequence
  mRNA product Design2 comprising derived and/or modified sequence from Homo sapiens__NP_000592.3__HsHGF (opt6)
ggggcgcugccuacggagguggcagccaucuccuucucggcaucaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1863 - RNA, 2569 nt, Artificial Sequence
  mRNA product Design2 comprising derived and/or modified sequence from Mus musculus__NP_001276387.1__MmHGF (opt6)
ggggcgcugccuacggagguggcagccaucuccuucucggcaucaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1864 - RNA, 1000 nt, Artificial Sequence
  mRNA product Design2 comprising derived and/or modified sequence from Homo sapiens__NP_005253.3__HsGFER (opt6)
ggggcgcugccuacggagguggcagccaucuccuucucggcaucaagcuuaccauggcagcaccaggagaaagaggaagauuucaugggggaaauuuauuuuuucuaccaggaggugcaagaagugaaaugauggaugaucuggcaacagaugcaagaggaagaggagcaggaagaagagaugcagcagcaagcgcaaguacaccagcacaagcaccaacaagugauaguccaguagcagaagaugcaaguagaagaagaccauguagagcauguguagauuuuaaaacauggaugagaacacaacaaaaaagagauacaaaauuuagagaagacuguccaccagacagagaagaauuaggaagacauucaugggcaguauuacauacauuagcagcauauuauccagaucuaccaacgccagaacaacaacaagauauggcacaauuuauacauuuauuuaguaaauuuuauccaugugaagaaugugcagaagauuuaagaaaaagacuuuguagaaaucauccagauacaagaacaagagcauguuuuacacaaugguuaugucauuuacauaaugaaguaaauagaaaauuaggaaaaccagauuuugauuguagcaaaguagaugaaagauggagagauggauggaaagauggaaguugugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1865 - RNA, 1012 nt, Artificial Sequence
  mRNA product Design2 comprising derived and/or modified sequence from Homo sapiens__NP_061986.1__HsFGF21(L126R,P199G,A208E) (opt7)
ggggcgcugccuacggagguggcagccaucuccuucucggcaucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1866 - RNA, 2569 nt, Artificial Sequence
  mRNA product Design2 comprising derived and/or modified sequence from Homo sapiens__NP_000592.3__HsHGF (opt7)
ggggcgcugccuacggagguggcagccaucuccuucucggcaucaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1867 - RNA, 2569 nt, Artificial Sequence
  mRNA product Design2 comprising derived and/or modified sequence from Mus musculus__NP_001276387.1__MmHGF (opt7)
ggggcgcugccuacggagguggcagccaucuccuucucggcaucaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1868 - RNA, 1000 nt, Artificial Sequence
  mRNA product Design2 comprising derived and/or modified sequence from Homo sapiens__NP_005253.3__HsGFER (opt7)
ggggcgcugccuacggagguggcagccaucuccuucucggcaucaagcuuaccauggccgcacccggcgagagggggcgguuccacgguggcaaccuguuuuuccucccagggggcgcccgcagcgaaaugauggacgaucuggcgaccgacgccaggggucgcggggcaggccggagggaugccgcagccuccgcgaguacuccggcccaggcacccaccagcgacuccccaguggccgaggaugccagucggcgcaggcccugccgggcaugugucgacuuuaagacguggaugcgcacucaacagaaaagggauaccaaguuccgggaagacugcccacccgaucgcgaggaauugggcaggcauagcugggccgugcugcacacccucgcggccuacuauccagaccugccgacucccgagcagcagcaagauauggcacaguuuauccauuuguucuccaaauuuuacccaugugaggaaugcgccgaggaccugcggaagcgccucuguaggaaucaccccgauacccggacgcgcgcaugcuucacucaguggcugugucaucugcacaacgaaguaaauaggaaacucgggaagccagacuuugacugcagcaagguggaugagcgguggagggacgguuggaaagauggcuccugugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1869 - RNA, 1012 nt, Artificial Sequence
  mRNA product Design2 comprising derived and/or modified sequence from Homo sapiens__NP_061986.1__HsFGF21(L126R,P199G,A208E) (opt8)
ggggcgcugccuacggagguggcagccaucuccuucucggcaucaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1870 - RNA, 2569 nt, Artificial Sequence
  mRNA product Design2 comprising derived and/or modified sequence from Homo sapiens__NP_000592.3__HsHGF (opt8)
ggggcgcugccuacggagguggcagccaucuccuucucggcaucaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1871 - RNA, 2375 nt, Artificial Sequence
  mRNA product Design2 comprising derived and/or modified sequence from Mus musculus__NP_001276387.1__MmHGF (opt8)
ggggcgcugccuacggagguggcagccaucuccuucucggcaucaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1872 - RNA, 1000 nt, Artificial Sequence
  mRNA product Design2 comprising derived and/or modified sequence from Homo sapiens__NP_005253.3__HsGFER (opt8)
ggggcgcugccuacggagguggcagccaucuccuucucggcaucaagcuuaccauggccgcacccggcgaacgcggccgauuccacggcggaaacuuauucuuccucccaggcggcgcacgcuccgaaaugauggacgaccuagcaaccgacgcccgcggacgaggcgccggccgacgcgacgcagccgcaucagccagcacacccgcacaagccccaaccagcgacuccccagucgccgaagacgccucacgccgacgccccugcagagccugcgucgacuucaaaaccuggaugcgcacccaacaaaaacgcgacacaaaauucagagaagacugcccacccgaccgcgaagaacuaggcagacacucaugggccguccuccacacccuagccgccuacuaccccgaccuacccacccccgaacaacaacaagacauggcacaauucauacaccuauucuccaaauucuacccaugcgaagaaugcgccgaagaccuccgaaaacgacucugccgcaaccaccccgacacccgaacacgcgcaugcuucacccaauggcuaugccaccuacacaacgaaguaaaccgaaaacuaggaaaacccgacuucgacugcagcaaagucgacgaacgauggcgagacggcuggaaagacggauccugcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1873 - RNA, 1012 nt, Artificial Sequence
  mRNA product Design2 comprising derived and/or modified sequence from Homo sapiens__NP_061986.1__HsFGF21(L126R,P199G,A208E) (opt9)
ggggcgcugccuacggagguggcagccaucuccuucucggcaucaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1874 - RNA, 2569 nt, Artificial Sequence
  mRNA product Design2 comprising derived and/or modified sequence from Homo sapiens__NP_000592.3__HsHGF (opt9)
ggggcgcugccuacggagguggcagccaucuccuucucggcaucaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1875 - RNA, 2569 nt, Artificial Sequence
  mRNA product Design2 comprising derived and/or modified sequence from Mus musculus__NP_001276387.1__MmHGF (opt9)
ggggcgcugccuacggagguggcagccaucuccuucucggcaucaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1876 - RNA, 1000 nt, Artificial Sequence
  mRNA product Design2 comprising derived and/or modified sequence from Homo sapiens__NP_005253.3__HsGFER (opt9)
ggggcgcugccuacggagguggcagccaucuccuucucggcaucaagcuuaccauggcagcacccggcgaacgcggacgauuccacggcggcaaccucuucuuccuccccggcggcgccagauccgaaaugauggacgaccuagccacagacgccagaggccgaggcgccggaagacgcgacgcagccgccagcgcaagcacacccgcccaagcccccaccagcgacagcccaguagcagaagacgccucacgccgccgacccugccgagcaugcgucgacuucaaaaccuggaugagaacccaacaaaaacgcgacaccaaauucagagaagacugcccacccgaccgcgaagaacucggccgacacucaugggcaguccuacacacacucgcagccuacuacccagaccuccccacacccgaacaacaacaagacauggcccaauucauccaccucuucagcaaauucuacccaugcgaagaaugcgcagaagaucucagaaaacggcucugccgcaaccacccagacacccgcacccgcgccugcuucacccaauggcucugccaccuccacaacgaaguaaaccgaaaacucggaaaacccgacuucgacugcagcaaagucgacgaacgauggcgagacggcuggaaagacggaagcugcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1877 - RNA, 1012 nt, Artificial Sequence
  mRNA product Design2 comprising derived and/or modified sequence from Homo sapiens__NP_061986.1__HsFGF21(L126R,P199G,A208E) (opt11)
ggggcgcugccuacggagguggcagccaucuccuucucggcaucaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1878 - RNA, 2569 nt, Artificial Sequence
  mRNA product Design2 comprising derived and/or modified sequence from Homo sapiens__NP_000592.3__HsHGF (opt11)
ggggcgcugccuacggagguggcagccaucuccuucucggcaucaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1879 - RNA, 2569 nt, Artificial Sequence
  mRNA product Design2 comprising derived and/or modified sequence from Mus musculus__NP_001276387.1__MmHGF (opt11)
ggggcgcugccuacggagguggcagccaucuccuucucggcaucaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1880 - RNA, 1000 nt, Artificial Sequence
  mRNA product Design2 comprising derived and/or modified sequence from Homo sapiens__NP_005253.3__HsGFER (opt11)
ggggcgcugccuacggagguggcagccaucuccuucucggcaucaagcuuaccauggcagcaccaggcgaacgcggacgcuuccacggaggcaaccuauucuuccuacccggaggcgcacgcucagaaaugauggacgaccuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacacucgcggccuacuacccagaccuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaauggcuaugccaccuacacaacgaaguaaaccgcaaacucggaaaaccagacuucgacugcagcaaagucgacgaaagguggagagacggauggaaagacggaagcugcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1881 - RNA, 1012 nt, Artificial Sequence
  mRNA product Design2 comprising derived and/or modified sequence from Homo sapiens__NP_061986.1__HsFGF21(L126R,P199G,A208E) (opt12)
ggggcgcugccuacggagguggcagccaucuccuucucggcaucaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1882 - RNA, 2569 nt, Artificial Sequence
  mRNA product Design2 comprising derived and/or modified sequence from Homo sapiens__NP_000592.3__HsHGF (opt12)
ggggcgcugccuacggagguggcagccaucuccuucucggcaucaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1883 - RNA, 2569 nt, Artificial Sequence
  mRNA product Design2 comprising derived and/or modified sequence from Mus musculus__NP_001276387.1__MmHGF (opt12)
ggggcgcugccuacggagguggcagccaucuccuucucggcaucaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1884 - RNA, 1000 nt, Artificial Sequence
  mRNA product Design2 comprising derived and/or modified sequence from Homo sapiens__NP_005253.3__HsGFER (opt12)
ggggcgcugccuacggagguggcagccaucuccuucucggcaucaagcuuaccauggcugcaccaggagaaagaggaagauuucauggaggaaauuuauucuuuuuaccaggaggagcaagaagugaaaugauggaugauuuagcaacagaugcaagaggaagaggagcaggaagaagagaugcagcagcaagugcaaguacaccagcacaagcaccaacaagugauaguccaguagcagaagaugcaaguagaagaagaccauguagagcauguguagauuuuaaaacauggaugagaacacaacaaaagagagauacaaaauuuagagaagauuguccaccagauagagaagaacuaggaagacauaguugggcaguacuacauacacuagcagcauauuauccagauuuaccaacaccagaacaacaacaagauauggcacaauuuauacauuuauuuaguaaauuuuacccaugugaagaaugugcggaagauuuaagaaaaagauuauguagaaaucauccagauacaagaacaagagcauguuuuacucaaugguuaugucauuuacauaaugaaguaaauagaaaauuaggaaaaccagauuuugauuguaguaaaguagaugaaagauggagagacggauggaaagauggaaguugugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1885 - RNA, 1012 nt, Artificial Sequence
  mRNA product Design2 comprising derived and/or modified sequence from Homo sapiens__NP_061986.1__HsFGF21(L126R,P199G,A208E) (opt13)
ggggcgcugccuacggagguggcagccaucuccuucucggcaucaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1886 - RNA, 2569 nt, Artificial Sequence
  mRNA product Design2 comprising derived and/or modified sequence from Homo sapiens__NP_000592.3__HsHGF (opt13)
ggggcgcugccuacggagguggcagccaucuccuucucggcaucaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1887 - RNA, 2569 nt, Artificial Sequence
  mRNA product Design2 comprising derived and/or modified sequence from Mus musculus__NP_001276387.1__MmHGF (opt13)
ggggcgcugccuacggagguggcagccaucuccuucucggcaucaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1888 - RNA, 1000 nt, Artificial Sequence
  mRNA product Design2 comprising derived and/or modified sequence from Homo sapiens__NP_005253.3__HsGFER (opt13)
ggggcgcugccuacggagguggcagccaucuccuucucggcaucaagcuuaccauggcggcaccaggagaaagaggaagauuucaugguggaaauuuauucuuuuuaccaggaggagcaagaucagaaaugauggaugacuuagcaacggaugcaagaggaagaggagcaggaagaagagaugcagcagcaucagcaucaacaccagcacaagcaccaacaagcgauaguccaguagcagaagaugcaagcagaagaagaccauguagagcauguguagauuuuaaaacauggaugagaacacaacaaaaacgagacacaaaauuuagagaagauuguccaccagauagagaagaauuaggaagacacucaugggcaguauuacauacauuagcagcauauuauccagaucuaccaacaccagaacaacaacaagauauggcacaauuuauacauuuauuuucaaaauuuuauccaugugaagaaugugcagaagaucuaagaaaaagacuauguagaaaucauccagauacaagaacaagagcauguuuuacacaaugguuaugucacuuacacaacgaaguaaauagaaaauuaggaaaaccagauuuugauuguaguaaaguagaugaaagauggagagauggauggaaagauggaaguugugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1889 - RNA, 977 nt, Artificial Sequence
  mRNA product Design3 comprising derived and/or modified sequence from Homo sapiens__NP_061986.1__HsFGF21(L126R,P199G,A208E) (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1890 - RNA, 977 nt, Artificial Sequence
  mRNA product Design3 comprising derived and/or modified sequence from Homo sapiens__NP_061986.1__HsFGF21(L126R,P199G,A208E) (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1891 - RNA, 2534 nt, Artificial Sequence
  mRNA product Design3 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1892 - RNA, 2534 nt, Artificial Sequence
  mRNA product Design3 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1893 - RNA, 2534 nt, Artificial Sequence
  mRNA product Design3 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1894 - RNA, 2534 nt, Artificial Sequence
  mRNA product Design3 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1895 - RNA, 965 nt, Artificial Sequence
  mRNA product Design3 comprising derived and/or modified sequence from Homo sapiens__NP_005253.3__HsGFER (wt)
gggagagucccgcagucggcguccagcggcucugcuuguucgugugugugucguugcaggccuuauucaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccugcacaaugaagugaaccgcaagcugggcaagccugacuucgacugcucaaaaguggaugagcgcuggcgcgacggcuggaaggauggcuccugugacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1896 - RNA, 965 nt, Artificial Sequence
  mRNA product Design3 comprising derived and/or modified sequence from Homo sapiens__NP_005253.3__HsGFER (wt)
gggagagucccgcagucggcguccagcggcucugcuuguucgugugugugucguugcaggccuuauucaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccuccacaaugaagugaaccgcaagcugggcaagccugacuucgacugcucaaaaguggaugagcgcuggcgcgacggcuggaaggauggcuccugugacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1897 - RNA, 977 nt, Artificial Sequence
  mRNA product Design3 comprising derived and/or modified sequence from Homo sapiens__NP_061986.1__HsFGF21(L126R,P199G,A208E) (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1898 - RNA, 2534 nt, Artificial Sequence
  mRNA product Design3 comprising derived and/or modified sequence from Homo sapiens__NP_000592.3__HsHGF (opt1)
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1899 - RNA, 2534 nt, Artificial Sequence
  mRNA product Design3 comprising derived and/or modified sequence from Mus musculus__NP_001276387.1__MmHGF (opt1)
gggagagucccgcagucggcguccagcggcucugcuuguucgugugugugucguugcaggccuuauucaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1900 - RNA, 965 nt, Artificial Sequence
  mRNA product Design3 comprising derived and/or modified sequence from Homo sapiens__NP_005253.3__HsGFER (opt1)
gggagagucccgcagucggcguccagcggcucugcuuguucgugugugugucguugcaggccuuauucaagcuuaccauggccgcccccggcgagcgcgggcgguuccacggcgggaaccuguucuuccugccgggcggggcgcgcagcgagaugauggacgaccuggccaccgacgcccggggccgcggcgccgggcggcgcgacgccgcggccuccgccagcacccccgcccaggcgcccacguccgacagccccguggccgaggacgccucccggcgccggccgugccgcgccugcgucgacuucaagaccuggaugcggacccagcagaagcgcgacaccaaguuccgggaggacugcccgcccgaccgcgaggagcugggccggcacagcugggccgugcuccacacgcuggcggccuacuaccccgaccugcccacccccgagcagcagcaggacauggcccaguucauccaccucuucuccaaguucuaccccugcgaggagugcgccgaggaccugcgcaagcggcugugccgcaaccaccccgacacccggacccgcgccugcuucacgcaguggcucugccaccuccacaacgaggugaaccggaagcuggggaagccggacuucgacugcagcaaggucgacgagcgcuggcgcgacggcuggaaggacggguccugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1901 - RNA, 977 nt, Artificial Sequence
  mRNA product Design3 comprising derived and/or modified sequence from Homo sapiens__NP_061986.1__HsFGF21(L126R,P199G,A208E) (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1902 - RNA, 2534 nt, Artificial Sequence
  mRNA product Design3 comprising derived and/or modified sequence from Homo sapiens__NP_000592.3__HsHGF (opt2)
gggagagucccgcagucggcguccagcggcucugcuuguucgugugugugucguugcaggccuuauucaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1903 - RNA, 2534 nt, Artificial Sequence
  mRNA product Design3 comprising derived and/or modified sequence from Mus musculus__NP_001276387.1__MmHGF (opt2)
gggagagucccgcagucggcguccagcggcucugcuuguucgugugugugucguugcaggccuuauucaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1904 - RNA, 965 nt, Artificial Sequence
  mRNA product Design3 comprising derived and/or modified sequence from Homo sapiens__NP_005253.3__HsGFER (opt2)
gggagagucccgcagucggcguccagcggcucugcuuguucgugugugugucguugcaggccuuauucaagcuuaccauggccgcccccggcgagcgcggccgcuuccacggcggcaaccucuucuuccuccccggcggcgcccgcuccgagaugauggacgaccucgccaccgacgcccgcggccgcggcgccggccgccgcgacgccgccgccuccgccuccacccccgcccaggcccccaccuccgacucccccgucgccgaggacgccucccgccgccgccccugccgcgccugcgucgacuucaagaccuggaugcgcacccagcagaagcgcgacaccaaguuccgcgaggacugcccccccgaccgcgaggagcucggccgccacuccugggccguccuccacacccucgccgccuacuaccccgaccuccccacccccgagcagcagcaggacauggcccaguucauccaccucuucuccaaguucuaccccugcgaggagugcgccgaggaccuccgcaagcgccucugccgcaaccaccccgacacccgcacccgcgccugcuucacccaguggcucugccaccuccacaacgaggucaaccgcaagcucggcaagcccgacuucgacugcuccaaggucgacgagcgcuggcgcgacggcuggaaggacggcuccugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1905 - RNA, 977 nt, Artificial Sequence
  mRNA product Design3 comprising derived and/or modified sequence from Homo sapiens__NP_061986.1__HsFGF21(L126R,P199G,A208E) (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1906 - RNA, 2534 nt, Artificial Sequence
  mRNA product Design3 comprising derived and/or modified sequence from Homo sapiens__NP_000592.3__HsHGF (opt3)
gggagagucccgcagucggcguccagcggcucugcuuguucgugugugugucguugcaggccuuauucaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1907 - RNA, 2534 nt, Artificial Sequence
  mRNA product Design3 comprising derived and/or modified sequence from Mus musculus__NP_001276387.1__MmHGF (opt3)
gggagagucccgcagucggcguccagcggcucugcuuguucgugugugugucguugcaggccuuauucaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1908 - RNA, 965 nt, Artificial Sequence
  mRNA product Design3 comprising derived and/or modified sequence from Homo sapiens__NP_005253.3__HsGFER (opt3)
gggagagucccgcagucggcguccagcggcucugcuuguucgugugugugucguugcaggccuuauucaagcuuaccauggccgcucccggcgagagagggagguuccacggagguaaccuguuuuuccucccuggcggggcacggagcgaaaugauggacgaucuugccaccgacgcgcgcggacgaggcgcuggucguagagaugccgcagccuccgcuucuacaccagcacaggccccgacuucagacagucccguggcugaggaugccagcaggcggcgcccuugcagagcgugugucgacuuuaagacguggaugaggacccaacagaaacgggauacaaaguuccgcgaagacugcccacccgaucgagaggaacuggggagacauuccugggcaguuuugcacacuuuagccgcuuacuauccugaccugccaacccccgagcagcagcaagauauggcccaguuuauccaucuauucucuaaauuuuacccuugugaggaaugcgcagaggaccucaggaagcggcugugucguaaucacccagauacacgcaccagagcuugcuucacucaguggcuuugucaucugcacaacgaagugaauaggaaauugggaaagccggacuuugacugcucgaagguagaugagcgguggcgagacggcuggaaagauggcucaugugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1909 - RNA, 977 nt, Artificial Sequence
  mRNA product Design3 comprising derived and/or modified sequence from Homo sapiens__NP_061986.1__HsFGF21(L126R,P199G,A208E) (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1910 - RNA, 2534 nt, Artificial Sequence
  mRNA product Design3 comprising derived and/or modified sequence from Homo sapiens__NP_000592.3__HsHGF (opt4)
gggagagucccgcagucggcguccagcggcucugcuuguucgugugugugucguugcaggccuuauucaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1911 - RNA, 2534 nt, Artificial Sequence
  mRNA product Design3 comprising derived and/or modified sequence from Mus musculus__NP_001276387.1__MmHGF (opt4)
gggagagucccgcagucggcguccagcggcucugcuuguucgugugugugucguugcaggccuuauucaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1912 - RNA, 965 nt, Artificial Sequence
  mRNA product Design3 comprising derived and/or modified sequence from Homo sapiens__NP_005253.3__HsGFER (opt4)
gggagagucccgcagucggcguccagcggcucugcuuguucgugugugugucguugcaggccuuauucaagcuuaccauggccgcccccggcgagagaggcagauuccacggcggcaaccuguucuuccugcccggcggcgccagaagcgagaugauggacgaccuggccaccgacgccagaggcagaggcgccggcagaagagacgccgccgccagcgccagcacccccgcccaggcccccaccagcgacagccccguggccgaggacgccagcagaagaagacccugcagagccugcguggacuucaagaccuggaugagaacccagcagaagagagacaccaaguucagagaggacugcccccccgacagagaggagcugggcagacacagcugggccgugcugcacacccuggccgccuacuaccccgaccugcccacccccgagcagcagcaggacauggcccaguucauccaccuguucagcaaguucuaccccugcgaggagugcgccgaggaccugagaaagagacugugcagaaaccaccccgacaccagaaccagagccugcuucacccaguggcugugccaccugcacaacgaggugaacagaaagcugggcaagcccgacuucgacugcagcaagguggacgagagauggagagacggcuggaaggacggcagcugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1913 - RNA, 977 nt, Artificial Sequence
  mRNA product Design3 comprising derived and/or modified sequence from Homo sapiens__NP_061986.1__HsFGF21(L126R,P199G,A208E) (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1914 - RNA, 2534 nt, Artificial Sequence
  mRNA product Design3 comprising derived and/or modified sequence from Homo sapiens__NP_000592.3__HsHGF (opt5)
gggagagucccgcagucggcguccagcggcucugcuuguucgugugugugucguugcaggccuuauucaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1915 - RNA, 2534 nt, Artificial Sequence
  mRNA product Design3 comprising derived and/or modified sequence from Mus musculus__NP_001276387.1__MmHGF (opt5)
gggagagucccgcagucggcguccagcggcucugcuuguucgugugugugucguugcaggccuuauucaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1916 - RNA, 965 nt, Artificial Sequence
  mRNA product Design3 comprising derived and/or modified sequence from Homo sapiens__NP_005253.3__HsGFER (opt5)
gggagagucccgcagucggcguccagcggcucugcuuguucgugugugugucguugcaggccuuauucaagcuuaccauggccgcucccggcgagagagggcgguuccacggaggcaaccuguuuuuccucccugggggagcccgcagcgaaaugauggacgaucuggcgaccgacgcuagaggccgcggggccggacggagagaugccgcugccuccgcuucuacaccggcccaggcgcccacgagcgacuccccuguggccgaggaugcuucucggcgcagacccugccgggccugugucgacuuuaagaccuggaugcgcacacaacagaaaagagauaccaaguuccgggaagacugcccucccgaucgcgaggaacuuggcagacauagcugggcuguucugcacacacucgccgcguacuauccugaccugccgacccccgagcagcagcaagauauggcccaguuuauccaucuuuucuccaaauuuuacccuugugaggaaugcgcugaggaccugcggaagcgccucuguagaaaucaccccgauacacggaccagagccugcuucacgcaguggcugugucaucugcacaacgaagugaaucgcaaacucggcaagccugacuuugacugcucuaagguggaugagcgguggagagacggguggaaagauggaagcugugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1917 - RNA, 977 nt, Artificial Sequence
  mRNA product Design3 comprising derived and/or modified sequence from Homo sapiens__NP_061986.1__HsFGF21(L126R,P199G,A208E) (opt6)
gggagagucccgcagucggcguccagcggcucugcuuguucgugugugugucguugcaggccuuauucaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1918 - RNA, 2534 nt, Artificial Sequence
  mRNA product Design3 comprising derived and/or modified sequence from Homo sapiens__NP_000592.3__HsHGF (opt6)
gggagagucccgcagucggcguccagcggcucugcuuguucgugugugugucguugcaggccuuauucaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1919 - RNA, 2534 nt, Artificial Sequence
  mRNA product Design3 comprising derived and/or modified sequence from Mus musculus__NP_001276387.1__MmHGF (opt6)
gggagagucccgcagucggcguccagcggcucugcuuguucgugugugugucguugcaggccuuauucaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1920 - RNA, 965 nt, Artificial Sequence
  mRNA product Design3 comprising derived and/or modified sequence from Homo sapiens__NP_005253.3__HsGFER (opt6)
gggagagucccgcagucggcguccagcggcucugcuuguucgugugugugucguugcaggccuuauucaagcuuaccauggcagcaccaggagaaagaggaagauuucaugggggaaauuuauuuuuucuaccaggaggugcaagaagugaaaugauggaugaucuggcaacagaugcaagaggaagaggagcaggaagaagagaugcagcagcaagcgcaaguacaccagcacaagcaccaacaagugauaguccaguagcagaagaugcaaguagaagaagaccauguagagcauguguagauuuuaaaacauggaugagaacacaacaaaaaagagauacaaaauuuagagaagacuguccaccagacagagaagaauuaggaagacauucaugggcaguauuacauacauuagcagcauauuauccagaucuaccaacgccagaacaacaacaagauauggcacaauuuauacauuuauuuaguaaauuuuauccaugugaagaaugugcagaagauuuaagaaaaagacuuuguagaaaucauccagauacaagaacaagagcauguuuuacacaaugguuaugucauuuacauaaugaaguaaauagaaaauuaggaaaaccagauuuugauuguagcaaaguagaugaaagauggagagauggauggaaagauggaaguugugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1921 - RNA, 977 nt, Artificial Sequence
  mRNA product Design3 comprising derived and/or modified sequence from Homo sapiens__NP_061986.1__HsFGF21(L126R,P199G,A208E) (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1922 - RNA, 2534 nt, Artificial Sequence
  mRNA product Design3 comprising derived and/or modified sequence from Homo sapiens__NP_000592.3__HsHGF (opt7)
gggagagucccgcagucggcguccagcggcucugcuuguucgugugugugucguugcaggccuuauucaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1923 - RNA, 2534 nt, Artificial Sequence
  mRNA product Design3 comprising derived and/or modified sequence from Mus musculus__NP_001276387.1__MmHGF (opt7)
gggagagucccgcagucggcguccagcggcucugcuuguucgugugugugucguugcaggccuuauucaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1924 - RNA, 965 nt, Artificial Sequence
  mRNA product Design3 comprising derived and/or modified sequence from Homo sapiens__NP_005253.3__HsGFER (opt7)
gggagagucccgcagucggcguccagcggcucugcuuguucgugugugugucguugcaggccuuauucaagcuuaccauggccgcacccggcgagagggggcgguuccacgguggcaaccuguuuuuccucccagggggcgcccgcagcgaaaugauggacgaucuggcgaccgacgccaggggucgcggggcaggccggagggaugccgcagccuccgcgaguacuccggcccaggcacccaccagcgacuccccaguggccgaggaugccagucggcgcaggcccugccgggcaugugucgacuuuaagacguggaugcgcacucaacagaaaagggauaccaaguuccgggaagacugcccacccgaucgcgaggaauugggcaggcauagcugggccgugcugcacacccucgcggccuacuauccagaccugccgacucccgagcagcagcaagauauggcacaguuuauccauuuguucuccaaauuuuacccaugugaggaaugcgccgaggaccugcggaagcgccucuguaggaaucaccccgauacccggacgcgcgcaugcuucacucaguggcugugucaucugcacaacgaaguaaauaggaaacucgggaagccagacuuugacugcagcaagguggaugagcgguggagggacgguuggaaagauggcuccugugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1925 - RNA, 977 nt, Artificial Sequence
  mRNA product Design3 comprising derived and/or modified sequence from Homo sapiens__NP_061986.1__HsFGF21(L126R,P199G,A208E) (opt8)
gggagagucccgcagucggcguccagcggcucugcuuguucgugugugugucguugcaggccuuauucaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1926 - RNA, 2534 nt, Artificial Sequence
  mRNA product Design3 comprising derived and/or modified sequence from Homo sapiens__NP_000592.3__HsHGF (opt8)
gggagagucccgcagucggcguccagcggcucugcuuguucgugugugugucguugcaggccuuauucaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1927 - RNA, 2340 nt, Artificial Sequence
  mRNA product Design3 comprising derived and/or modified sequence from Mus musculus__NP_001276387.1__MmHGF (opt8)
gggagagucccgcagucggcguccagcggcucugcuuguucgugugugugucguugcaggccuuauucaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1928 - RNA, 965 nt, Artificial Sequence
  mRNA product Design3 comprising derived and/or modified sequence from Homo sapiens__NP_005253.3__HsGFER (opt8)
gggagagucccgcagucggcguccagcggcucugcuuguucgugugugugucguugcaggccuuauucaagcuuaccauggccgcacccggcgaacgcggccgauuccacggcggaaacuuauucuuccucccaggcggcgcacgcuccgaaaugauggacgaccuagcaaccgacgcccgcggacgaggcgccggccgacgcgacgcagccgcaucagccagcacacccgcacaagccccaaccagcgacuccccagucgccgaagacgccucacgccgacgccccugcagagccugcgucgacuucaaaaccuggaugcgcacccaacaaaaacgcgacacaaaauucagagaagacugcccacccgaccgcgaagaacuaggcagacacucaugggccguccuccacacccuagccgccuacuaccccgaccuacccacccccgaacaacaacaagacauggcacaauucauacaccuauucuccaaauucuacccaugcgaagaaugcgccgaagaccuccgaaaacgacucugccgcaaccaccccgacacccgaacacgcgcaugcuucacccaauggcuaugccaccuacacaacgaaguaaaccgaaaacuaggaaaacccgacuucgacugcagcaaagucgacgaacgauggcgagacggcuggaaagacggauccugcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1929 - RNA, 977 nt, Artificial Sequence
  mRNA product Design3 comprising derived and/or modified sequence from Homo sapiens__NP_061986.1__HsFGF21(L126R,P199G,A208E) (opt9)
gggagagucccgcagucggcguccagcggcucugcuuguucgugugugugucguugcaggccuuauucaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1930 - RNA, 2534 nt, Artificial Sequence
  mRNA product Design3 comprising derived and/or modified sequence from Homo sapiens__NP_000592.3__HsHGF (opt9)
gggagagucccgcagucggcguccagcggcucugcuuguucgugugugugucguugcaggccuuauucaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1931 - RNA, 2534 nt, Artificial Sequence
  mRNA product Design3 comprising derived and/or modified sequence from Mus musculus__NP_001276387.1__MmHGF (opt9)
gggagagucccgcagucggcguccagcggcucugcuuguucgugugugugucguugcaggccuuauucaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1932 - RNA, 965 nt, Artificial Sequence
  mRNA product Design3 comprising derived and/or modified sequence from Homo sapiens__NP_005253.3__HsGFER (opt9)
gggagagucccgcagucggcguccagcggcucugcuuguucgugugugugucguugcaggccuuauucaagcuuaccauggcagcacccggcgaacgcggacgauuccacggcggcaaccucuucuuccuccccggcggcgccagauccgaaaugauggacgaccuagccacagacgccagaggccgaggcgccggaagacgcgacgcagccgccagcgcaagcacacccgcccaagcccccaccagcgacagcccaguagcagaagacgccucacgccgccgacccugccgagcaugcgucgacuucaaaaccuggaugagaacccaacaaaaacgcgacaccaaauucagagaagacugcccacccgaccgcgaagaacucggccgacacucaugggcaguccuacacacacucgcagccuacuacccagaccuccccacacccgaacaacaacaagacauggcccaauucauccaccucuucagcaaauucuacccaugcgaagaaugcgcagaagaucucagaaaacggcucugccgcaaccacccagacacccgcacccgcgccugcuucacccaauggcucugccaccuccacaacgaaguaaaccgaaaacucggaaaacccgacuucgacugcagcaaagucgacgaacgauggcgagacggcuggaaagacggaagcugcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1933 - RNA, 977 nt, Artificial Sequence
  mRNA product Design3 comprising derived and/or modified sequence from Homo sapiens__NP_061986.1__HsFGF21(L126R,P199G,A208E) (opt11)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1934 - RNA, 2534 nt, Artificial Sequence
  mRNA product Design3 comprising derived and/or modified sequence from Homo sapiens__NP_000592.3__HsHGF (opt11)
gggagagucccgcagucggcguccagcggcucugcuuguucgugugugugucguugcaggccuuauucaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1935 - RNA, 2534 nt, Artificial Sequence
  mRNA product Design3 comprising derived and/or modified sequence from Mus musculus__NP_001276387.1__MmHGF (opt11)
gggagagucccgcagucggcguccagcggcucugcuuguucgugugugugucguugcaggccuuauucaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1936 - RNA, 965 nt, Artificial Sequence
  mRNA product Design3 comprising derived and/or modified sequence from Homo sapiens__NP_005253.3__HsGFER (opt11)
gggagagucccgcagucggcguccagcggcucugcuuguucgugugugugucguugcaggccuuauucaagcuuaccauggcagcaccaggcgaacgcggacgcuuccacggaggcaaccuauucuuccuacccggaggcgcacgcucagaaaugauggacgaccuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacacucgcggccuacuacccagaccuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaauggcuaugccaccuacacaacgaaguaaaccgcaaacucggaaaaccagacuucgacugcagcaaagucgacgaaagguggagagacggauggaaagacggaagcugcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1937 - RNA, 977 nt, Artificial Sequence
  mRNA product Design3 comprising derived and/or modified sequence from Homo sapiens__NP_061986.1__HsFGF21(L126R,P199G,A208E) (opt12)
gggagagucccgcagucggcguccagcggcucugcuuguucgugugugugucguugcaggccuuauucaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1938 - RNA, 2534 nt, Artificial Sequence
  mRNA product Design3 comprising derived and/or modified sequence from Homo sapiens__NP_000592.3__HsHGF (opt12)
gggagagucccgcagucggcguccagcggcucugcuuguucgugugugugucguugcaggccuuauucaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1939 - RNA, 2534 nt, Artificial Sequence
  mRNA product Design3 comprising derived and/or modified sequence from Mus musculus__NP_001276387.1__MmHGF (opt12)
gggagagucccgcagucggcguccagcggcucugcuuguucgugugugugucguugcaggccuuauucaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1940 - RNA, 965 nt, Artificial Sequence
  mRNA product Design3 comprising derived and/or modified sequence from Homo sapiens__NP_005253.3__HsGFER (opt12)
gggagagucccgcagucggcguccagcggcucugcuuguucgugugugugucguugcaggccuuauucaagcuuaccauggcugcaccaggagaaagaggaagauuucauggaggaaauuuauucuuuuuaccaggaggagcaagaagugaaaugauggaugauuuagcaacagaugcaagaggaagaggagcaggaagaagagaugcagcagcaagugcaaguacaccagcacaagcaccaacaagugauaguccaguagcagaagaugcaaguagaagaagaccauguagagcauguguagauuuuaaaacauggaugagaacacaacaaaagagagauacaaaauuuagagaagauuguccaccagauagagaagaacuaggaagacauaguugggcaguacuacauacacuagcagcauauuauccagauuuaccaacaccagaacaacaacaagauauggcacaauuuauacauuuauuuaguaaauuuuacccaugugaagaaugugcggaagauuuaagaaaaagauuauguagaaaucauccagauacaagaacaagagcauguuuuacucaaugguuaugucauuuacauaaugaaguaaauagaaaauuaggaaaaccagauuuugauuguaguaaaguagaugaaagauggagagacggauggaaagauggaaguugugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1941 - RNA, 977 nt, Artificial Sequence
  mRNA product Design3 comprising derived and/or modified sequence from Homo sapiens__NP_061986.1__HsFGF21(L126R,P199G,A208E) (opt13)
gggagagucccgcagucggcguccagcggcucugcuuguucgugugugugucguugcaggccuuauucaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1942 - RNA, 2534 nt, Artificial Sequence
  mRNA product Design3 comprising derived and/or modified sequence from Homo sapiens__NP_000592.3__HsHGF (opt13)
gggagagucccgcagucggcguccagcggcucugcuuguucgugugugugucguugcaggccuuauucaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1943 - RNA, 2534 nt, Artificial Sequence
  mRNA product Design3 comprising derived and/or modified sequence from Mus musculus__NP_001276387.1__MmHGF (opt13)
gggagagucccgcagucggcguccagcggcucugcuuguucgugugugugucguugcaggccuuauucaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1944 - RNA, 965 nt, Artificial Sequence
  mRNA product Design3 comprising derived and/or modified sequence from Homo sapiens__NP_005253.3__HsGFER (opt13)
gggagagucccgcagucggcguccagcggcucugcuuguucgugugugugucguugcaggccuuauucaagcuuaccauggcggcaccaggagaaagaggaagauuucaugguggaaauuuauucuuuuuaccaggaggagcaagaucagaaaugauggaugacuuagcaacggaugcaagaggaagaggagcaggaagaagagaugcagcagcaucagcaucaacaccagcacaagcaccaacaagcgauaguccaguagcagaagaugcaagcagaagaagaccauguagagcauguguagauuuuaaaacauggaugagaacacaacaaaaacgagacacaaaauuuagagaagauuguccaccagauagagaagaauuaggaagacacucaugggcaguauuacauacauuagcagcauauuauccagaucuaccaacaccagaacaacaacaagauauggcacaauuuauacauuuauuuucaaaauuuuauccaugugaagaaugugcagaagaucuaagaaaaagacuauguagaaaucauccagauacaagaacaagagcauguuuuacacaaugguuaugucacuuacacaacgaaguaaauagaaaauuaggaaaaccagauuuugauuguaguaaaguagaugaaagauggagagauggauggaaagauggaaguugugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 1945 - RNA, 906 nt, Artificial Sequence
  mRNA product Design4 comprising derived and/or modified sequence from Homo sapiens__NP_061986.1__HsFGF21(L126R,P199G,A208E) (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1946 - RNA, 906 nt, Artificial Sequence
  mRNA product Design4 comprising derived and/or modified sequence from Homo sapiens__NP_061986.1__HsFGF21(L126R,P199G,A208E) (wt) R5988/R6155/R6227
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcggcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggagguucccagggccgaagccccagcuacgaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1947 - RNA, 2463 nt, Artificial Sequence
  mRNA product Design4 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1948 - RNA, 2463 nt, Artificial Sequence
  mRNA product Design4 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaguucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaaucccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcauggcuuggaauccaugauguccacggaagaggagaugagaaaugcaaacagguucucaauguuucccagcugguauauggcccugaaggaucagaucugguuuuaaugaagcuggccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1949 - RNA, 2463 nt, Artificial Sequence
  mRNA product Design4 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaauuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauucccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcuuggcuuggcauccacgauguucaugagagaggcgaggagaagcgcaagcagaucuuaaacauuucccagcuggucuaugguccugaaggcucagacuugguuuuacugaagcuugcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1950 - RNA, 2463 nt, Artificial Sequence
  mRNA product Design4 comprising derived and/or modified sequence from Mus musculus__NP_001276387.1__MmHGF (wt)
gggagagucccgcagucggcguccagcggcucugcuuguucgugugugugucguugcaggccuuauucaagcuuaccaugaugugggggaccaaacuucugccgguccuguugcugcagcauguccuccugcaccuccuccugcuucaugucgccauccccuaugcagaaggacagaagaaaagaagaaauacacuucaugaauuuaaaaagucagcaaaaacuacucuuaccaaggaagacccauuacugaagauuaaaaccaaaaaagugaacucugcagaugagugugccaacagguguaucaggaacaggggcuuuacguucacuugcaaggccuucguuuuugauaagucaagaaaacgaugcuacugguauccuuucaauaguaugucaaguggagugaaaaaaggguuuggccaugaauuugaccucuaugaaaacaaagacuauauuagaaacugcaucauugguaaaggaggcagcuauaaagggacgguauccaucacuaagaguggcaucaaaugccagccuuggaacuccaugaucccccaugaacacagcuuuuugccuucgagcuaucgcgguaaagaccuacaggaaaacuacugucgaaauccucgaggggaagaagggggacccugguguuucacaagcaauccagagguacgcuacgaagucugugacauuccucaguguucagaaguugaaugcaugaccugcaauggugaaagcuacagaggucccauggaucacacagaaucaggcaagacuugucagcgcugggaccagcagacaccacaccggcacaaguucuugccagaaagauaucccgacaagggcuuugaugauaauuauugccgcaauccugauggcaagccgaggccauggugcuacacucuugacccugacaccccuugggaguauugugcaauuaaaacgugcgcucacagugcugugaaugagacugaugucccuauggaaacaacugaaugcauucaaggccaaggagaagguuacaggggaaccagcaauaccauuuggaauggaauccccugucagcguugggauucgcaguacccucacaagcaugauaucacucccgagaacuucaaaugcaaggaccuuagagaaaauuauugccgcaauccagauggggcugaaucaccaugguguuuuaccacugacccaaacauccgaguuggcuacugcucucaaauucccaagugugacgugucaaguggacaagauuguuaucguggcaaugggaaaaauuacaugggcaacuuauccaaaacaaggucuggacuuacauguuccaugugggacaagaauauggaggauuuacaccgucauaucuucugggagccagaugcuagcaaauugaauaagaauuacugccggaauccugaugaugaugcccauggaccuuggugcuacacggggaauccucuuauuccuugggauuauugcccuauuucccguugugaaggagauacuacaccuacaauugucaauuuggaccauccuguaauauccugugccaaaacaaaacaacugcggguuguaaauggcauuccaacacaaacaacaguaggguggaugguuaguuugaaauacagaaauaaacauaucuguggaggaucauugauaaaggaaaguuggguucuuacugcaagacaauguuuuccagccagaaacaaagacuugaaagacuaugaagcauggcuuggcauccacgauguucaugagagaggcgaggagaagcgcaagcagaucuuaaacauuucccagcuggucuaugguccugaaggcucagacuugguuuuacugaagcuggcucgaccugcaauccuggauaacuuugucaguacaauugauuuaccuaguuaugguuguacaaucccugaaaagaccacuugcaguauuuacggcuggggcuacacuggauugaucaacgcggaugguuuauuacgaguagcucaucuguauauuauggggaaugagaaaugcagucagcaccaucaaggcaaggugacuuugaaugagucugaguuaugugcuggggcugaaaagauuggaucaggaccaugugagggagauuaugguggcccacucauuugugaacaacacaaaaugagaaugguucuuggugucauuguuccuggucguggaugugccaucccaaaucguccugguauuuuuguucgaguagcauauuaugcaaaauggauacacaaaguaauuuugacauacaaguuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1951 - RNA, 894 nt, Artificial Sequence
  mRNA product Design4 comprising derived and/or modified sequence from Homo sapiens__NP_005253.3__HsGFER (wt)
gggagagucccgcagucggcguccagcggcucugcuuguucgugugugugucguugcaggccuuauucaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccugcacaaugaagugaaccgcaagcugggcaagccugacuucgacugcucaaaaguggaugagcgcuggcgcgacggcuggaaggauggcuccugugacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1952 - RNA, 894 nt, Artificial Sequence
  mRNA product Design4 comprising derived and/or modified sequence from Homo sapiens__NP_005253.3__HsGFER (wt)
gggagagucccgcagucggcguccagcggcucugcuuguucgugugugugucguugcaggccuuauucaagcuuaccauggcggcgcccggcgagcggggccgcuuccacggcgggaaccucuucuuccugccggggggcgcgcgcuccgagaugauggacgaccuggcgaccgacgcgcggggccggggcgcggggcggagagacgcggccgccucggccucgacgccagcccaggcgccgaccuccgauucuccugucgccgaggacgccucccggaggcggccgugccgggccugcgucgacuucaagacguggaugcggacgcagcagaagcgggacaccaaguuuagggaggacugcccgccggaucgcgaggaacugggccgccacagcugggcuguccuccacacccuggccgccuacuaccccgaccugcccaccccagaacagcagcaagacauggcccaguucauacauuuauuuucuaaguuuuaccccugugaggagugugcugaagaccuaagaaaaaggcugugcaggaaccacccagacacccgcacccgggcaugcuucacacaguggcugugccaccuccacaaugaagugaaccgcaagcugggcaagccugacuucgacugcucaaaaguggaugagcgcuggcgcgacggcuggaaggauggcuccugugacuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1953 - RNA, 906 nt, Artificial Sequence
  mRNA product Design4 comprising derived and/or modified sequence from Homo sapiens__NP_061986.1__HsFGF21(L126R,P199G,A208E) (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcgccugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggggcucccagggccggagccccuccuacgagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1954 - RNA, 2463 nt, Artificial Sequence
  mRNA product Design4 comprising derived and/or modified sequence from Homo sapiens__NP_000592.3__HsHGF (opt1)
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1955 - RNA, 2463 nt, Artificial Sequence
  mRNA product Design4 comprising derived and/or modified sequence from Mus musculus__NP_001276387.1__MmHGF (opt1) R6151/R6244
gggagagucccgcagucggcguccagcggcucugcuuguucgugugugugucguugcaggccuuauucaagcuuaccaugauguggggcaccaagcugcuccccgugcugcugcuccagcacguccugcugcaccuccugcugcuccacguggccaucccguacgccgaggggcagaagaagcgccggaacacccugcacgaguucaagaagagcgcgaagacgacccugaccaaggaggacccccuccugaagaucaagaccaagaaggugaacuccgccgacgagugcgccaaccgcugcauccggaaccgcggcuucacguucaccugcaaggccuucgucuucgacaagagccggaagcgcugcuacugguaccccuucaacuccaugagcuccggggugaagaagggcuucgggcacgaguucgaccuguacgagaacaaggacuacauccggaacugcaucaucggcaagggcgggagcuacaagggcaccguguccaucaccaagagcgggaucaagugccagcccuggaacuccaugaucccgcacgagcacagcuuccuccccuccagcuaccgcggcaaggaccugcaggagaacuacugccggaacccccgcggggaggagggcggccccuggugcuucacguccaacccggagguccgguacgaggugugcgacaucccccagugcagcgagguggagugcaugaccugcaacggggaguccuaccgcggccccauggaccacaccgagagcgggaagaccugccagcggugggaccagcagacgccccaccgccacaaguuccugccggagcgguaccccgacaagggcuucgacgacaacuacugccgcaaccccgacggcaagccccggccguggugcuacacccucgaccccgacacccccugggaguacugcgccaucaagaccugcgcgcacuccgccgucaacgagacggacgugcccauggagaccaccgagugcauccaggggcagggcgagggguaccgcggcaccagcaacacgaucuggaacgggaucccgugccagcggugggacucccaguacccccacaagcacgacaucacccccgagaacuucaagugcaaggaccugcgcgagaacuacugccggaaccccgacggcgccgagagcccguggugcuucaccaccgaccccaacauccgcgugggcuacugcagccagauccccaagugcgacgucuccagcgggcaggacugcuaccgcggcaacgggaagaacuacaugggcaaccuguccaagacgcggagcgggcucaccugcuccaugugggacaagaacauggaggaccugcaccgccacaucuucugggagcccgacgccagcaagcugaacaagaacuacugccggaacccggacgacgacgcgcacggccccuggugcuacaccggcaacccccucaucccgugggacuacugccccaucucccgcugcgagggggacaccacgcccaccaucgugaaccuggaccaccccgugaucagcugcgccaagaccaagcagcugcgggucgugaacggcaucccgacccagacgaccgugggguggauggucucccucaaguaccgcaacaagcacaucugcggcgggagccugaucaaggaguccugggugcugaccgcccggcagugcuuccccgcccgcaacaaggaccucaaggacuacgaggccuggcugggcauccacgacgugcacgagcggggcgaggagaagcgcaagcagauccugaacaucagccagcucgucuacgggcccgagggcuccgaccuggugcugcucaagcuggcgcggcccgccauccuggacaacuucgugagcaccaucgaccucccguccuacgggugcacgauccccgagaagaccaccugcagcaucuacggcuggggcuacaccgggcugaucaacgccgacggccugcuccgcgucgcccaccuguacaucauggggaacgagaagugcucccagcaccaccagggcaaggugacccugaacgagagcgagcucugcgccggggcggagaagaucggcuccggccccugcgagggggacuacggcgggccccugaucugcgagcagcacaagaugcggaugguccugggcgugaucgugccggggcgcggcugcgccauccccaaccggcccggcaucuucguccgcguggccuacuacgccaaguggauccacaaggugauccugacguacaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1956 - RNA, 894 nt, Artificial Sequence
  mRNA product Design4 comprising derived and/or modified sequence from Homo sapiens__NP_005253.3__HsGFER (opt1)
gggagagucccgcagucggcguccagcggcucugcuuguucgugugugugucguugcaggccuuauucaagcuuaccauggccgcccccggcgagcgcgggcgguuccacggcgggaaccuguucuuccugccgggcggggcgcgcagcgagaugauggacgaccuggccaccgacgcccggggccgcggcgccgggcggcgcgacgccgcggccuccgccagcacccccgcccaggcgcccacguccgacagccccguggccgaggacgccucccggcgccggccgugccgcgccugcgucgacuucaagaccuggaugcggacccagcagaagcgcgacaccaaguuccgggaggacugcccgcccgaccgcgaggagcugggccggcacagcugggccgugcuccacacgcuggcggccuacuaccccgaccugcccacccccgagcagcagcaggacauggcccaguucauccaccucuucuccaaguucuaccccugcgaggagugcgccgaggaccugcgcaagcggcugugccgcaaccaccccgacacccggacccgcgccugcuucacgcaguggcucugccaccuccacaacgaggugaaccggaagcuggggaagccggacuucgacugcagcaaggucgacgagcgcuggcgcgacggcuggaaggacggguccugcgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1957 - RNA, 906 nt, Artificial Sequence
  mRNA product Design4 comprising derived and/or modified sequence from Homo sapiens__NP_061986.1__HsFGF21(L126R,P199G,A208E) (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcgccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggcggcucccagggccgcucccccuccuacgaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1958 - RNA, 2463 nt, Artificial Sequence
  mRNA product Design4 comprising derived and/or modified sequence from Homo sapiens__NP_000592.3__HsHGF (opt2)
gggagagucccgcagucggcguccagcggcucugcuuguucgugugugugucguugcaggccuuauucaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1959 - RNA, 2463 nt, Artificial Sequence
  mRNA product Design4 comprising derived and/or modified sequence from Mus musculus__NP_001276387.1__MmHGF (opt2)
gggagagucccgcagucggcguccagcggcucugcuuguucgugugugugucguugcaggccuuauucaagcuuaccaugauguggggcaccaagcuccuccccguccuccuccuccagcacguccuccuccaccuccuccuccuccacgucgccauccccuacgccgagggccagaagaagcgccgcaacacccuccacgaguucaagaaguccgccaagaccacccucaccaaggaggacccccuccucaagaucaagaccaagaaggucaacuccgccgacgagugcgccaaccgcugcauccgcaaccgcggcuucaccuucaccugcaaggccuucgucuucgacaagucccgcaagcgcugcuacugguaccccuucaacuccauguccuccggcgucaagaagggcuucggccacgaguucgaccucuacgagaacaaggacuacauccgcaacugcaucaucggcaagggcggcuccuacaagggcaccgucuccaucaccaaguccggcaucaagugccagcccuggaacuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccccauggaccacaccgaguccggcaagaccugccagcgcugggaccagcagaccccccaccgccacaaguuccuccccgagcgcuaccccgacaagggcuucgacgacaacuacugccgcaaccccgacggcaagccccgccccuggugcuacacccucgaccccgacacccccugggaguacugcgccaucaagaccugcgcccacuccgccgucaacgagaccgacguccccauggagaccaccgagugcauccagggccagggcgagggcuaccgcggcaccuccaacaccaucuggaacggcauccccugccagcgcugggacucccaguacccccacaagcacgacaucacccccgagaacuucaagugcaaggaccuccgcgagaacuacugccgcaaccccgacggcgccgagucccccuggugcuucaccaccgaccccaacauccgcgucggcuacugcucccagauccccaagugcgacgucuccuccggccaggacugcuaccgcggcaacggcaagaacuacaugggcaaccucuccaagacccgcuccggccucaccugcuccaugugggacaagaacauggaggaccuccaccgccacaucuucugggagcccgacgccuccaagcucaacaagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccagaccaccgucggcuggauggucucccucaaguaccgcaacaagcacaucugcggcggcucccucaucaaggaguccuggguccucaccgcccgccagugcuuccccgcccgcaacaaggaccucaaggacuacgaggccuggcucggcauccacgacguccacgagcgcggcgaggagaagcgcaagcagauccucaacaucucccagcucgucuacggccccgagggcuccgaccucguccuccucaagcucgcccgccccgccauccucgacaacuucgucuccaccaucgaccuccccuccuacggcugcaccauccccgagaagaccaccugcuccaucuacggcuggggcuacaccggccucaucaacgccgacggccuccuccgcgucgcccaccucuacaucaugggcaacgagaagugcucccagcaccaccagggcaaggucacccucaacgaguccgagcucugcgccggcgccgagaagaucggcuccggccccugcgagggcgacuacggcggcccccucaucugcgagcagcacaagaugcgcaugguccucggcgucaucguccccggccgcggcugcgccauccccaaccgccccggcaucuucguccgcgucgccuacuacgccaaguggauccacaaggucauccucaccuacaagcucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1960 - RNA, 894 nt, Artificial Sequence
  mRNA product Design4 comprising derived and/or modified sequence from Homo sapiens__NP_005253.3__HsGFER (opt2)
gggagagucccgcagucggcguccagcggcucugcuuguucgugugugugucguugcaggccuuauucaagcuuaccauggccgcccccggcgagcgcggccgcuuccacggcggcaaccucuucuuccuccccggcggcgcccgcuccgagaugauggacgaccucgccaccgacgcccgcggccgcggcgccggccgccgcgacgccgccgccuccgccuccacccccgcccaggcccccaccuccgacucccccgucgccgaggacgccucccgccgccgccccugccgcgccugcgucgacuucaagaccuggaugcgcacccagcagaagcgcgacaccaaguuccgcgaggacugcccccccgaccgcgaggagcucggccgccacuccugggccguccuccacacccucgccgccuacuaccccgaccuccccacccccgagcagcagcaggacauggcccaguucauccaccucuucuccaaguucuaccccugcgaggagugcgccgaggaccuccgcaagcgccucugccgcaaccaccccgacacccgcacccgcgccugcuucacccaguggcucugccaccuccacaacgaggucaaccgcaagcucggcaagcccgacuucgacugcuccaaggucgacgagcgcuggcgcgacggcuggaaggacggcuccugcgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1961 - RNA, 906 nt, Artificial Sequence
  mRNA product Design4 comprising derived and/or modified sequence from Homo sapiens__NP_061986.1__HsFGF21(L126R,P199G,A208E) (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugagagauuacuggaagauggguauaacgucuaccagagcgaggcacacggacuucccuugcaucugccugguaauaaaaguccacacagggaccccgccccucggggcccagcucgcuuucuaccgcuccccgggcugccuccagcccuucccgaaccuccaggcauucuggcgccccagccgccugaugugggauccucugaccccuugagcaugguuggugggucccagggaagaucaccaaguuaugagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1962 - RNA, 2463 nt, Artificial Sequence
  mRNA product Design4 comprising derived and/or modified sequence from Homo sapiens__NP_000592.3__HsHGF (opt3)
gggagagucccgcagucggcguccagcggcucugcuuguucgugugugugucguugcaggccuuauucaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1963 - RNA, 2463 nt, Artificial Sequence
  mRNA product Design4 comprising derived and/or modified sequence from Mus musculus__NP_001276387.1__MmHGF (opt3)
gggagagucccgcagucggcguccagcggcucugcuuguucgugugugugucguugcaggccuuauucaagcuuaccaugauguggggcaccaagcugcuccccgugcuucuguugcagcacgucuuacugcaucuacuccugcuucacguugccaucccuuacgcugaggggcaaaagaagagaaggaacacacugcaugaguucaaaaagagcgcaaaaacuacguugaccaaggaggacccacuccugaagauuaaaacaaagaaaguaaauuccgccgaugaaugcgcgaaccgguguauacgcaaucgaggauuuacuuuuaccugcaaggcuuucguguucgacaaaucucguaagagauguuauugguacccguuuaacucaaugaguagcggugugaagaaaggcuucgggcacgaguuugaucuguaugaaaauaaggacuacaucaggaacugcauuaucggaaaaggcgguuccuauaaggggacagucucuauuaccaaaucgggaaucaagugucagcccuggaacucaaugauaccucaugagcacagcuuccucccaaguuccuaccggggcaaagauuuacaggagaauuauugccgcaaucccagaggcgaagaagggggaccuugguguuuuacuucuaacccagaagugagguacgagguuugcgacaucccccaguguagcgagguggaaugcaugacauguaauggugaguccuaccggggcccuauggaucacaccgaaucagggaagacgugccaacgcugggaccagcagacuccacaucgacacaaguuccugccggagagauaucccgauaaaggauuugacgauaacuacugcaggaauccugacggcaagccacggcccugguguuauacccuugauccugacacaccaugggaauacugcgccauuaaaacuugugcacauagugccgucaacgagaccgacgugcccauggagacaaccgaaugcauccagggucaaggggagggauaucguggcacgagcaauacuauuuggaacggcaucccgugucagcgcugggauucucaguacccucacaagcacgacauaacacccgaaaacuucaaaugcaaggauuugagagagaauuauuguaggaacccagacggggcugaauccccuuggugcuuuaccacugaucccaauauucggguaggauacuguucacagaucccaaagugcgacguuagcaguggucaagauuguuaccgaggcaacgggaaaaauuauaugggaaaccugucuaagacacgcuccggccuaaccugcagcaugugggacaaaaauauggaggaucuccauagacacauuuucugggagcccgacgcaucgaagcugaacaaaaauuacugcaggaacccugaugacgacgcccaugguccaugguguuauacggggaauccgcuuauccccugggauuacugcccuaucucucggugugaaggcgacaccacaccaacuauugugaaccuggaucaccccgucauauccugcgcuaagaccaagcaguugcgcguggugaauggaaucccuacacagacuaccgucggcuggaugguuucacucaaauauagaaacaagcauauuugugggggaagucugaucaaagagagcuggguguuaacagccaggcaaugcuucccagcgcguaauaaggaccugaaagauuacgaagcauggcucgguauacacgacguacacgagcggggcgaagagaagcgaaagcagauucuuaacaucucccagcugguguaugggcccgagggaucugauuugguccuacugaaacucgccagaccggcuauccuggacaacuuugugagcaccauugaucuuccuucauacggcuguacuaucccagaaaagacgacaugcaguauuuacgguuggggguauaccggccugauaaaugccgacggauugcucaggguugcacaucuguacaucaugggcaacgagaaauguucccagcaccaucaagggaaggugacuuuaaaugaaagcgagcugugcgcuggagccgagaaaauugguucuggccccugugaaggggauuauggaggcccucuaaucugcgagcagcacaagaugcgcaugguccucggugugaucguacccgggcggggcugcgcgauuccaaacagaccuggaauauucguuaggguggccuacuaugcaaaauggauccacaaggucauucugaccuacaaacuuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1964 - RNA, 894 nt, Artificial Sequence
  mRNA product Design4 comprising derived and/or modified sequence from Homo sapiens__NP_005253.3__HsGFER (opt3)
gggagagucccgcagucggcguccagcggcucugcuuguucgugugugugucguugcaggccuuauucaagcuuaccauggccgcucccggcgagagagggagguuccacggagguaaccuguuuuuccucccuggcggggcacggagcgaaaugauggacgaucuugccaccgacgcgcgcggacgaggcgcuggucguagagaugccgcagccuccgcuucuacaccagcacaggccccgacuucagacagucccguggcugaggaugccagcaggcggcgcccuugcagagcgugugucgacuuuaagacguggaugaggacccaacagaaacgggauacaaaguuccgcgaagacugcccacccgaucgagaggaacuggggagacauuccugggcaguuuugcacacuuuagccgcuuacuauccugaccugccaacccccgagcagcagcaagauauggcccaguuuauccaucuauucucuaaauuuuacccuugugaggaaugcgcagaggaccucaggaagcggcugugucguaaucacccagauacacgcaccagagcuugcuucacucaguggcuuugucaucugcacaacgaagugaauaggaaauugggaaagccggacuuugacugcucgaagguagaugagcgguggcgagacggcuggaaagauggcucaugugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1965 - RNA, 906 nt, Artificial Sequence
  mRNA product Design4 comprising derived and/or modified sequence from Homo sapiens__NP_061986.1__HsFGF21(L126R,P199G,A208E) (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagagacugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggcggcagccagggcagaagccccagcuacgagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1966 - RNA, 2463 nt, Artificial Sequence
  mRNA product Design4 comprising derived and/or modified sequence from Homo sapiens__NP_000592.3__HsHGF (opt4)
gggagagucccgcagucggcguccagcggcucugcuuguucgugugugugucguugcaggccuuauucaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1967 - RNA, 2463 nt, Artificial Sequence
  mRNA product Design4 comprising derived and/or modified sequence from Mus musculus__NP_001276387.1__MmHGF (opt4)
gggagagucccgcagucggcguccagcggcucugcuuguucgugugugugucguugcaggccuuauucaagcuuaccaugauguggggcaccaagcugcugcccgugcugcugcugcagcacgugcugcugcaccugcugcugcugcacguggccauccccuacgccgagggccagaagaagagaagaaacacccugcacgaguucaagaagagcgccaagaccacccugaccaaggaggacccccugcugaagaucaagaccaagaaggugaacagcgccgacgagugcgccaacagaugcaucagaaacagaggcuucaccuucaccugcaaggccuucguguucgacaagagcagaaagagaugcuacugguaccccuucaacagcaugagcagcggcgugaagaagggcuucggccacgaguucgaccuguacgagaacaaggacuacaucagaaacugcaucaucggcaagggcggcagcuacaagggcaccgugagcaucaccaagagcggcaucaagugccagcccuggaacagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccccauggaccacaccgagagcggcaagaccugccagagaugggaccagcagaccccccacagacacaaguuccugcccgagagauaccccgacaagggcuucgacgacaacuacugcagaaaccccgacggcaagcccagacccuggugcuacacccuggaccccgacacccccugggaguacugcgccaucaagaccugcgcccacagcgccgugaacgagaccgacgugcccauggagaccaccgagugcauccagggccagggcgagggcuacagaggcaccagcaacaccaucuggaacggcauccccugccagagaugggacagccaguacccccacaagcacgacaucacccccgagaacuucaagugcaaggaccugagagagaacuacugcagaaaccccgacggcgccgagagccccuggugcuucaccaccgaccccaacaucagagugggcuacugcagccagauccccaagugcgacgugagcagcggccaggacugcuacagaggcaacggcaagaacuacaugggcaaccugagcaagaccagaagcggccugaccugcagcaugugggacaagaacauggaggaccugcacagacacaucuucugggagcccgacgccagcaagcugaacaagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccacccagaccaccgugggcuggauggugagccugaaguacagaaacaagcacaucugcggcggcagccugaucaaggagagcugggugcugaccgccagacagugcuuccccgccagaaacaaggaccugaaggacuacgaggccuggcugggcauccacgacgugcacgagagaggcgaggagaagagaaagcagauccugaacaucagccagcugguguacggccccgagggcagcgaccuggugcugcugaagcuggccagacccgccauccuggacaacuucgugagcaccaucgaccugcccagcuacggcugcaccauccccgagaagaccaccugcagcaucuacggcuggggcuacaccggccugaucaacgccgacggccugcugagaguggcccaccuguacaucaugggcaacgagaagugcagccagcaccaccagggcaaggugacccugaacgagagcgagcugugcgccggcgccgagaagaucggcagcggccccugcgagggcgacuacggcggcccccugaucugcgagcagcacaagaugagaauggugcugggcgugaucgugcccggcagaggcugcgccauccccaacagacccggcaucuucgugagaguggccuacuacgccaaguggauccacaaggugauccugaccuacaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1968 - RNA, 894 nt, Artificial Sequence
  mRNA product Design4 comprising derived and/or modified sequence from Homo sapiens__NP_005253.3__HsGFER (opt4)
gggagagucccgcagucggcguccagcggcucugcuuguucgugugugugucguugcaggccuuauucaagcuuaccauggccgcccccggcgagagaggcagauuccacggcggcaaccuguucuuccugcccggcggcgccagaagcgagaugauggacgaccuggccaccgacgccagaggcagaggcgccggcagaagagacgccgccgccagcgccagcacccccgcccaggcccccaccagcgacagccccguggccgaggacgccagcagaagaagacccugcagagccugcguggacuucaagaccuggaugagaacccagcagaagagagacaccaaguucagagaggacugcccccccgacagagaggagcugggcagacacagcugggccgugcugcacacccuggccgccuacuaccccgaccugcccacccccgagcagcagcaggacauggcccaguucauccaccuguucagcaaguucuaccccugcgaggagugcgccgaggaccugagaaagagacugugcagaaaccaccccgacaccagaaccagagccugcuucacccaguggcugugccaccugcacaacgaggugaacagaaagcugggcaagcccgacuucgacugcagcaagguggacgagagauggagagacggcuggaaggacggcagcugcgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1969 - RNA, 906 nt, Artificial Sequence
  mRNA product Design4 comprising derived and/or modified sequence from Homo sapiens__NP_061986.1__HsFGF21(L126R,P199G,A208E) (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagagacugcuugaagauggcuauaacguguaccaguccgaggcccacgggcugccccuccaucugccuggaaauaaaagcccgcaccgggaccccgcgccucgcggccccgccagauuucugccucuccccgggcugccgccugcccuucccgaaccucccggaauccuggcuccccagccuccggauguugggucuuccgacccccucagcauggugggcgggucucagggacgguccccuagcuaugagucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1970 - RNA, 2463 nt, Artificial Sequence
  mRNA product Design4 comprising derived and/or modified sequence from Homo sapiens__NP_000592.3__HsHGF (opt5)
gggagagucccgcagucggcguccagcggcucugcuuguucgugugugugucguugcaggccuuauucaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1971 - RNA, 2463 nt, Artificial Sequence
  mRNA product Design4 comprising derived and/or modified sequence from Mus musculus__NP_001276387.1__MmHGF (opt5)
gggagagucccgcagucggcguccagcggcucugcuuguucgugugugugucguugcaggccuuauucaagcuuaccaugauguggggcaccaagcugcuccccgugcugcuucugcagcacguccuccugcaucuucugcuccugcacguugccaucccuuacgcugaggggcagaaaaagagacggaacacacugcaugaguucaaaaagagcgccaaaacgacccucacaaaggaagacccgcugcuuaagauuaaaaccaagaaagucaauuccgcggaugaaugcgcuaaccgcuguaucagaaaucggggauuuacauuuaccugcaaggccuucguguucgacaaaucucgcaagagauguuauugguaccccuuuaacagcauguccucuggcgugaagaaaggguucggacacgaguuugaucuguaugaaaauaaggacuacauucggaacugcaucauuggcaaagggggaagcuauaagggcacaguguccaucaccaaaucuggcaucaagugucaaccuuggaauagcaugauuccccaugagcacuccuuccucccuagcucuuaccgcgggaaagaucugcaggagaacuauugcagaaauccccggggagaagagggcgggccuugguguuuuacguccaacccggaaguucgcuacgaggugugcgacaucccccaguguagcgaggucgaaugcaugaccuguaauggagagucuuacagaggcccuauggaucacacagaauccgggaagaccugccaacggugggaccagcagacaccccaucgccacaaguuccuuccugagagauaucccgauaaaggauuugacgauaacuacugccggaauccggacggcaagccucgccccugguguuauacccuggauccugacacgcccugggaauacugcgccauuaaaacaugugcucauagcgccgugaacgagaccgacguucccauggagacaaccgaaugcauccagggccaaggggagggauauagaggcaccucuaauacaauuuggaacgggaucccuugucagcggugggauucccaguacccgcacaagcacgacauuacgcccgaaaacuucaaaugcaaggaucucagagagaauuauugucgcaacccugacggagcugaaagccccuggugcuuuaccacagauccuaauauccgggugggcuacuguucccagauccccaagugcgacgucucuagcgggcaagauuguuacagaggaaacggcaaaaauuauaugggcaaccuguccaagacccgcagcgggcugacaugcucuaugugggacaaaaauauggaggaucuccaucggcacauuuucugggagccggacgccuccaagcugaacaaaaauuacugcagaaacccugaugacgacgcgcauggacccugguguuauaccggcaauccucuuauccccugggauuacugcccuauuagccgcugugaaggggacacgacacccaccaucgugaaccuggaucacccggugauuucuugcgccaagaccaagcagcuccgggucguuaauggaaucccuacacagaccacagugggcuggauggugagccugaaauauagaaacaagcauaucugugggggcucccuuauuaaagagucuuggguccugacggcucgccaaugcuuccccgcccggaauaaggaccucaaagauuacgaggcuuggcugggaauccacgacgugcacgaaagaggcgaagagaagcgcaagcagauucugaacaucagccagcucguuuaugggcccgagggauccgaucuggugcuucugaaacucgcccggccugcgauucuggacaacuuugucagcaccaucgaucuuccgucuuacggcuguacaauccccgaaaagaccacaugcuccauuuacggguggggauauaccggccugaucaaugccgacgggcuccugagaguggcucaucuguacauuaugggcaacgagaaauguagccagcaccaucaaggaaagguuacgcucaaugaaucugagcugugcgccggcgcugagaaaaucggguccggaccuugugaaggcgauuaugggggaccccuuauuugcgagcagcacaagaugcggauggugcugggcgucaucgugccugggcgcggcugcgccauucccaacagaccuggaaucuucguccggguggccuacuaugcuaaauggauccacaagguuauucucaccuacaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1972 - RNA, 894 nt, Artificial Sequence
  mRNA product Design4 comprising derived and/or modified sequence from Homo sapiens__NP_005253.3__HsGFER (opt5)
gggagagucccgcagucggcguccagcggcucugcuuguucgugugugugucguugcaggccuuauucaagcuuaccauggccgcucccggcgagagagggcgguuccacggaggcaaccuguuuuuccucccugggggagcccgcagcgaaaugauggacgaucuggcgaccgacgcuagaggccgcggggccggacggagagaugccgcugccuccgcuucuacaccggcccaggcgcccacgagcgacuccccuguggccgaggaugcuucucggcgcagacccugccgggccugugucgacuuuaagaccuggaugcgcacacaacagaaaagagauaccaaguuccgggaagacugcccucccgaucgcgaggaacuuggcagacauagcugggcuguucugcacacacucgccgcguacuauccugaccugccgacccccgagcagcagcaagauauggcccaguuuauccaucuuuucuccaaauuuuacccuugugaggaaugcgcugaggaccugcggaagcgccucuguagaaaucaccccgauacacggaccagagccugcuucacgcaguggcugugucaucugcacaacgaagugaaucgcaaacucggcaagccugacuuugacugcucuaagguggaugagcgguggagagacggguggaaagauggaagcugugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1973 - RNA, 906 nt, Artificial Sequence
  mRNA product Design4 comprising derived and/or modified sequence from Homo sapiens__NP_061986.1__HsFGF21(L126R,P199G,A208E) (opt6)
gggagagucccgcagucggcguccagcggcucugcuuguucgugugugugucguugcaggccuuauucaagcuuaccauggauucagaugaaacaggauuugaacacucaggauuaugggucucaguuuuagcaggacuauuacuaggagcaugucaagcacauccaauaccagacucaagcccauuauuacaauuuggaggacaaguaagacaaagauauuuauauacagaugacgcacaacaaacagaagcacauuuagaaauaagagaagacggcacaguaggaggagcagcagaucaaucaccagaaucacuauuacaauuaaaagcauuaaaaccaggaguaauacaaauauuaggaguaaaaacaucaagauucuuaugccaaagaccugacggagcauuauaugguucacuacacuuugacccagaagcauguucauucagagaaagacuacuagaagacggauauaauguuuaccaaucugaagcacauggauuaccacuacacuuaccaggaaauaaaucaccacaccgagacccagcaccacgaggaccagcaagauuccuaccacuaccaggauuaccaccagcauuaccagaaccaccaggaauacuagcuccacaaccaccagacguaggauccucagauccauuaucaaugguaggaggaucucaagguagaagucccucauacgaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1974 - RNA, 2463 nt, Artificial Sequence
  mRNA product Design4 comprising derived and/or modified sequence from Homo sapiens__NP_000592.3__HsHGF (opt6)
gggagagucccgcagucggcguccagcggcucugcuuguucgugugugugucguugcaggccuuauucaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1975 - RNA, 2463 nt, Artificial Sequence
  mRNA product Design4 comprising derived and/or modified sequence from Mus musculus__NP_001276387.1__MmHGF (opt6)
gggagagucccgcagucggcguccagcggcucugcuuguucgugugugugucguugcaggccuuauucaagcuuaccaugauguggggaacaaaacuauuaccaguauuauuauuacaacaugucuuauuacauuuacuucuacuacauguugcaauacccuaugccgaaggacaaaagaaaagaagaaacacucuucacgaguucaagaaaagcgcaaaaacaacauuaacaaaagaagacccacuacuaaaaauaaaaacaaagaaaguaaacucagcagaugaaugugccaacagauguauuagaaaccgggguuuuacuuuuacaugcaaagccuucguauucgauaaaucaaggaaaagaugcuacugguauccauucaauucaaugucauccggagucaagaaaggauucggccaugaauuugaccuauacgaaaauaaagauuauaucagaaacuguauaauaggaaaaggugguucauacaaaggaacaguaucaauaacaaaaagcgguauuaaaugucaacccuggaacucuaugauuccucaugaacauucauuuuuaccaucaucauacagagguaaagacuuacaagaaaauuacugcagaaauccaaggggagaagaaggcggaccauggugcuuuacaucaaaucccgaaguaagauaugaaguaugcgacauaccacaauguagugaaguugaauguaugacauguaauggagaaagcuacagagguccaauggaucauacagaaucaggaaaaacaugccaaagaugggaucaacaaacaccgcauagacauaaauuuuuaccagaaagauauccagauaaaggauucgaugacaauuacuguaggaaucccgacggaaaaccacgaccauggugcuauacacuagacccugauacuccaugggaauauugcgcuauaaaaacuugugcacauucagcaguaaacgaaaccgacguaccaauggaaaccacugaauguauacaagggcaaggagaaggauacagaggaacaucaaauacaauauggaacggaauacccugucaaagaugggauagccaauauccacauaaacacgacauaaccccagaaaacuuuaaauguaaagaucuaagagaaaauuacugcagaaaucccgauggcgcagaaucaccauggugcuucacaacagaucccaacauaagagucggauauugcucccagauuccuaaaugugauguaagcuccgggcaagacugcuaccgaggcaacgguaaaaauuacaugggaaacuuaaguaaaacaagaucaggauuaacaugcaguaugugggauaaaaauauggaggacuuacauagacauauauucugggaaccagaugcaucaaaacuuaacaaaaauuauugcagaaacccagacgacgaugcacacggaccaugguguuauacaggaaauccacuuauaccaugggacuauuguccaauaucacgaugcgaaggagauacaacaccaacaauaguaaacuuagaucauccaguaauaaguugcgcaaaaacuaaacaauuacgaguuguuaacggaauaccaacacaaacuacagucggauggaugguuucauuaaaauauagaaacaaacacauaugcggaggaucccuuauaaaagaauccuggguauuaacagcaagacaauguuuuccagccagaaauaaagaucucaaagacuacgaagcaugguuaggcauacacgauguacaugaacgaggagaagaaaaacgaaaacaaauauuaaauauaagccagcuaguuuauggaccagaaggaucggacuuaguacuauuaaaacuugcaagaccagcaauccuagacaauuuugucucaacaaucgacuuacccucauauggaugcacuauuccggagaaaacaacaugcuccauauacggauggggauauacaggauugauaaaugcagauggauuacuaagaguagcacaucuauacauaaugggaaaugaaaaauguucacaacaccaucaaggaaaaguaacacuaaacgaaagcgaauuaugugcaggcgcagagaaaauaggcaguggaccaugugaaggagauuacgguggaccacuaauaugcgaacaacauaaaaugagaaugguccuaggaguaauaguccccggaagaggaugugcaauaccaaaucgaccgggcauauuuguaagaguagcauacuacgcaaaauggauacacaaaguaauacuaacauacaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1976 - RNA, 894 nt, Artificial Sequence
  mRNA product Design4 comprising derived and/or modified sequence from Homo sapiens__NP_005253.3__HsGFER (opt6)
gggagagucccgcagucggcguccagcggcucugcuuguucgugugugugucguugcaggccuuauucaagcuuaccauggcagcaccaggagaaagaggaagauuucaugggggaaauuuauuuuuucuaccaggaggugcaagaagugaaaugauggaugaucuggcaacagaugcaagaggaagaggagcaggaagaagagaugcagcagcaagcgcaaguacaccagcacaagcaccaacaagugauaguccaguagcagaagaugcaaguagaagaagaccauguagagcauguguagauuuuaaaacauggaugagaacacaacaaaaaagagauacaaaauuuagagaagacuguccaccagacagagaagaauuaggaagacauucaugggcaguauuacauacauuagcagcauauuauccagaucuaccaacgccagaacaacaacaagauauggcacaauuuauacauuuauuuaguaaauuuuauccaugugaagaaugugcagaagauuuaagaaaaagacuuuguagaaaucauccagauacaagaacaagagcauguuuuacacaaugguuaugucauuuacauaaugaaguaaauagaaaauuaggaaaaccagauuuugauuguagcaaaguagaugaaagauggagagauggauggaaagauggaaguugugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1977 - RNA, 906 nt, Artificial Sequence
  mRNA product Design4 comprising derived and/or modified sequence from Homo sapiens__NP_061986.1__HsFGF21(L126R,P199G,A208E) (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagaggcugcuggaagauggguauaacguguaccagagugaggcccacggcuugccccuccaucugccagguaauaaaagcccgcaccgggaccccgcaccacgcgggcccgccagguuucugccacuccccggccugccgcccgccuugccagaacccccaggcauccuggcaccccagccaccggaugugggguccagcgacccccucaguauggucgguggcucccaggggcggagcccauccuaugagaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1978 - RNA, 2463 nt, Artificial Sequence
  mRNA product Design4 comprising derived and/or modified sequence from Homo sapiens__NP_000592.3__HsHGF (opt7)
gggagagucccgcagucggcguccagcggcucugcuuguucgugugugugucguugcaggccuuauucaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1979 - RNA, 2463 nt, Artificial Sequence
  mRNA product Design4 comprising derived and/or modified sequence from Mus musculus__NP_001276387.1__MmHGF (opt7)
gggagagucccgcagucggcguccagcggcucugcuuguucgugugugugucguugcaggccuuauucaagcuuaccaugauguggggcaccaagcugcuccccgugcuguugcugcagcacguccuccugcauuugcugcuccugcacguggccaucccauacgcagaggggcagaaaaagaggcggaacacucugcaugaguucaaaaagagcgccaaaaccacgcucacuaaggaggacccgcuguugaagauuaaaaccaagaaaguaaauuccgcggaugaaugcgccaaccgcuguaucaggaaucgggguuuuaccuucacuugcaaggcauuuguguucgacaaaagucgcaagagguguuauugguaccccuuuaacagcauguccaguggcgucaaaaagggguucggccacgaguuugaucuguaugaaaauaaggacuacauucggaacugcaucauugguaaagggggcagcuauaagggcaccguguccaucacgaaaagcgggaucaagugucaaccauggaacuccaugauuccccaugagcacaguuuccucccaagcuccuaccgcgguaaagaucugcaggagaauuauugcaggaauccccggggcgaagaagggggcccaugguguuuuacuagcaacccggaagugcgcuacgaggucugcgacaucccccaguguagugagguggaaugcaugaccugcaauggugaguccuacagggggccaauggaucacacugaaagcggcaagaccugucaacggugggaccagcagacuccccaucgccacaaguuccugccagagagguaucccgauaaaggcuuugacgauaacuacugccggaauccggacgggaagccccgcccaugguguuauacguuggaucccgacacuccaugggaauacugcgccauuaaaaccugugcacauuccgccguaaacgagacugacgugcccauggagaccaccgaaugcauccagggucaaggcgagggguauaggggcaccaguaauacgauuuggaacgguaucccaugucagcggugggauagccaguacccgcacaagcacgacauuacccccgaaaacuucaaaugcaaggaucuccgcgagaauuauuguaggaacccagacggcgcggaaucccccuggugcuucacuaccgauccaaauauccgggucggguacugcagccagauccccaagugugacgugaguuccggccaagauugcuacagggggaacgguaaaaauuauaugggcaaccugagcaagacccgcagugggcugacuuguuccaugugggacaaaaauauggaggaucuccaucggcacaucuuuugggagccggacgccagcaagcugaacaaaaauuacugcaggaacccagaugacgacgcacauggccccugguguuauacggguaaucccuugauuccaugggauuacugccccauuagccgcugugaaggcgacaccacuccaaccaucgugaaccuggaucacccggucauuuccugcgccaagaccaagcagcuccgggugguaaaugggauccccacucagacgaccgugggcuggauggucagucugaaauauaggaacaagcauaucugugggggcagccugauuaaagaguccuggguguugacugcccgccaaugcuucccagcacggaauaaggaccucaaagauuacgaagccuggcuggguauccacgacgugcacgagaggggcgaagagaagcggaaacagauucugaacaucagccagcucgucuaugggcccgaggguagugaucugguguugcugaagcucgcgcgcccagccauucuggacaacuuuguauccaccaucgaucugcccagcuacggcuguacuaucccggaaaagaccacgugcuccauuuacggguggggcuauaccggguugaucaaugcagacggccuccugaggguggcccaucuguacauuauggguaacgagaaaugcagucagcaccaucaagggaaggucacucucaaugaaagcgagcugugugcaggcgccgagaaaaucggcuccgggccaugcgaaggugauuauggcgggcccuugauuugugagcagcacaagaugcggauggugcugggcgucaucgugccaggucgcgggugcgccauucccaacaggccgggcaucuucgugcggguagcguacuaugcaaaauggauccacaaggugauucucaccuacaagcugugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1980 - RNA, 894 nt, Artificial Sequence
  mRNA product Design4 comprising derived and/or modified sequence from Homo sapiens__NP_005253.3__HsGFER (opt7)
gggagagucccgcagucggcguccagcggcucugcuuguucgugugugugucguugcaggccuuauucaagcuuaccauggccgcacccggcgagagggggcgguuccacgguggcaaccuguuuuuccucccagggggcgcccgcagcgaaaugauggacgaucuggcgaccgacgccaggggucgcggggcaggccggagggaugccgcagccuccgcgaguacuccggcccaggcacccaccagcgacuccccaguggccgaggaugccagucggcgcaggcccugccgggcaugugucgacuuuaagacguggaugcgcacucaacagaaaagggauaccaaguuccgggaagacugcccacccgaucgcgaggaauugggcaggcauagcugggccgugcugcacacccucgcggccuacuauccagaccugccgacucccgagcagcagcaagauauggcacaguuuauccauuuguucuccaaauuuuacccaugugaggaaugcgccgaggaccugcggaagcgccucuguaggaaucaccccgauacccggacgcgcgcaugcuucacucaguggcugugucaucugcacaacgaaguaaauaggaaacucgggaagccagacuuugacugcagcaagguggaugagcgguggagggacgguuggaaagauggcuccugugacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1981 - RNA, 906 nt, Artificial Sequence
  mRNA product Design4 comprising derived and/or modified sequence from Homo sapiens__NP_061986.1__HsFGF21(L126R,P199G,A208E) (opt8)
gggagagucccgcagucggcguccagcggcucugcuuguucgugugugugucguugcaggccuuauucaagcuuaccauggacucugacgaaaccggcuucgaacacuccggacucugggucuccguccucgccggccuccuccuaggcgccugccaagcccaccccauccccgacucauccccacuccuacaauucggcggccaaguccgucaacgcuaccucuauaccgaugacgcccaacaaaccgaagcccaccucgaaauccgcgaagacggaaccgucggcggcgccgcugaccaaucacccgaaucccuccuccaacucaaagcacucaaacccggcguaauccaaauccucggcguaaaaaccucacgauuucuaugucaaagacccgacggagcccuauacggcucucuacacuucgacccagaagcaugcuccuuccgcgaacgacuccucgaagacggauacaacgucuaccaaucagaagcccacggccuaccccuccaccuccccggcaacaaaucuccccaccgcgaccccgcaccccgcggccccgcccgcuuccucccccuccccggccuacccccagcccuacccgaaccacccggcauacucgcaccccaaccacccgacgucggcuccuccgacccccuauccauggucggcggcucccaaggccgcucccccucauacgaaucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1982 - RNA, 2463 nt, Artificial Sequence
  mRNA product Design4 comprising derived and/or modified sequence from Homo sapiens__NP_000592.3__HsHGF (opt8)
gggagagucccgcagucggcguccagcggcucugcuuguucgugugugugucguugcaggccuuauucaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1983 - RNA, 2269 nt, Artificial Sequence
  mRNA product Design4 comprising derived and/or modified sequence from Mus musculus__NP_001276387.1__MmHGF (opt8)
gggagagucccgcagucggcguccagcggcucugcuuguucgugugugugucguugcaggccuuauucaagcuuaccaugauguggggcacgaaacugcucccaguauugcucuugcaacacguccuacuccaccuucuacugcuacacgucgcuauacccuaugccgaaggacaaaagaaacgucgcaacacccuacacgaauuuaagaaaagcgccaagaccacacucacuaaagaagauccccuacucaaaauaaagaccaaaaaggugaacucggcugacgaaugcgccaaccgaugcauccgaaacagaggcuucacuuuuaccugcaaagccuucguuuucgacaagagccgaaaacgaugcuacugguacccauucaacagcauguccuccgggguaaagaaaggcuucggacaugaguucgaucuauacgaaaauaaagacuacauaagaaacugcauaaucggcaaaggaggguccuacaaaggcacagucagcaucacaaagucagggaucaaaugccaacccuggaacuccaugauaccacacgagcacaguuuccucccuaguagcuaccgaggaaaagaccuccaggagaacuacugccgcaacccccgcggggaagaaggcggaccuuggugcuucacaagcaaccccgagguccgcuacgaggucugcgacaucccccaaugcagcgaagucgagugcaugaccuguaacggagaaucauaccgaggcccaauggaucacaccgaauccggaaaaacaugccaacgaugggaccaacaaacaccgcaccgacacaaguuccuccccgaacgguaccccgacaaaggauucgacgacaacuacugccgcaaccccgacggaaaaccacgaccauggugcuacacgcucgacccggacacccccugggaauacugcgccaucaaaaccugcgcacacucagcggugaacgaaaccgauguaccaauggaaacaaccgaaugcauccaaggacaaggagagggcuacaggggcacgucaaauaccaucuggaacggcauaccaugccagcgcugggacagucaguacccccacaaacacgacauaacccccgaaaacuucaaaugcaaagaccucagagaaaacuacugccgcaaccccgacggcgccgaaucccccugguguuucacaaccgacccaaacauccgcgugggcuacugcucacaaauccccaagugcgacguaucaagcggccaagacugcuaucgcgggaacggcaaaaacuacaugggaaaccucucaaagaccagaagcggccuaacaugcucaaugugggacaaaaacauggaggaccuccaccggcacaucuuuugggaacccgacgcuuccaaacucaacaaaaacuacugccgaaaccccgacgacgaugcacacggcccauggugcuacacaggcaacccccugauacccugggacuacugccccaucuccagaugcgagggcgacacaacaccgaccaucguaaaucucgaccaccccguaaucuccugcgccaaaacaaaacaacuaagggucgugaacggaauccccacccaaacaacagugggcuggauggucagccucaaauacagaaacaagcacaucugcggcggcucccucaucaaggaaagcuggguacuaacagccaggcaaugcuuccccgccagaaauaaagaucuaaaagacuacgaagccuggcuaggcauccaugacguccacgaacgcggcgaggagaaacgaaaacaaauucucaacaucucucaacucgucuauggaccagaagggagcgaccucguucuucugaaacucgcccggcccgcaaucuuagacaacuucgucagcacaaucgaccuccccucauacggaugcaccaucccagaaaagacaaccugcagcauauacggauggggcuacaccggccugaucaacgcagacggccuucucagagucgcccaucucuacaucaugggaaacgaaaaaugcagccaacaccaccaaggcaaaguaacgcucaacgaauccgaacucugcgccggagcagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1984 - RNA, 894 nt, Artificial Sequence
  mRNA product Design4 comprising derived and/or modified sequence from Homo sapiens__NP_005253.3__HsGFER (opt8)
gggagagucccgcagucggcguccagcggcucugcuuguucgugugugugucguugcaggccuuauucaagcuuaccauggccgcacccggcgaacgcggccgauuccacggcggaaacuuauucuuccucccaggcggcgcacgcuccgaaaugauggacgaccuagcaaccgacgcccgcggacgaggcgccggccgacgcgacgcagccgcaucagccagcacacccgcacaagccccaaccagcgacuccccagucgccgaagacgccucacgccgacgccccugcagagccugcgucgacuucaaaaccuggaugcgcacccaacaaaaacgcgacacaaaauucagagaagacugcccacccgaccgcgaagaacuaggcagacacucaugggccguccuccacacccuagccgccuacuaccccgaccuacccacccccgaacaacaacaagacauggcacaauucauacaccuauucuccaaauucuacccaugcgaagaaugcgccgaagaccuccgaaaacgacucugccgcaaccaccccgacacccgaacacgcgcaugcuucacccaauggcuaugccaccuacacaacgaaguaaaccgaaaacuaggaaaacccgacuucgacugcagcaaagucgacgaacgauggcgagacggcuggaaagacggauccugcgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1985 - RNA, 906 nt, Artificial Sequence
  mRNA product Design4 comprising derived and/or modified sequence from Homo sapiens__NP_061986.1__HsFGF21(L126R,P199G,A208E) (opt9)
gggagagucccgcagucggcguccagcggcucugcuuguucgugugugugucguugcaggccuuauucaagcuuaccauggacuccgacgaaaccggauucgaacacucaggccucugggucucaguccucgccggccuccuccucggagccugccaagcccacccaauccccgacuccucaccacuccuccaauucggcggccaaguccgacaacgauaccucuacaccgacgacgcccaacaaaccgaagcccaccucgaaauccgcgaagacggcacaguaggaggcgccgccgaccaaucacccgaaucccuacuccaacuaaaagcacucaaacccggcgucauccaaauacucggcgucaaaaccucaagauuccucugccaacgccccgacggcgcccucuacggcucccuccacuucgaccccgaagccugcuccuuccgcgaacgccuccucgaagacggcuacaacgucuaccaauccgaagcccacggccucccccuccaccucccaggcaacaaauccccacaccgcgaccccgcaccccgcggcccagcccgcuuccucccccuccccggacuacccccugcccuacccgaaccaccaggcauccucgcaccccaaccacccgacgucggcuccuccgacccccucucaaugguaggcggcucacaaggccgaucccccuccuacgaauccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1986 - RNA, 2463 nt, Artificial Sequence
  mRNA product Design4 comprising derived and/or modified sequence from Homo sapiens__NP_000592.3__HsHGF (opt9)
gggagagucccgcagucggcguccagcggcucugcuuguucgugugugugucguugcaggccuuauucaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1987 - RNA, 2463 nt, Artificial Sequence
  mRNA product Design4 comprising derived and/or modified sequence from Mus musculus__NP_001276387.1__MmHGF (opt9)
gggagagucccgcagucggcguccagcggcucugcuuguucgugugugugucguugcaggccuuauucaagcuuaccaugauguggggcacaaaacuccuuccgguacugcugcuacaacacgugcuucuccaccuccuucuacuccacgucgcaauccccuaugcagaagggcagaaaaagcgacgcaacacacuccacgaguucaagaaaucggccaaaacaacccuaaccaaagaggacccccuccucaaaaucaaaaccaagaaaguaaacuccgccgacgagugcgccaacagaugcauccgcaaccggggcuucaccuucacaugcaaagccuucguguucgauaaaagccgcaaacgaugcuacugguacccauucaacuccaugagcucgggaguuaagaaaggcuuuggccacgaauuugaccuauacgagaauaaagacuacauaagaaacugcaucaucgguaaaggcggcucauacaaagggaccguauccaucacaaaaagcggaauaaaaugccaaccguggaacucuaugauaccccacgaacacucauuccuaccauccucauaccgcggcaaagaccuacaagagaacuacugccgaaacccccgaggagaagaagggggaccauggugcuucaccucaaacccagagguacgguacgaagucugcgacaucccacaaugcagcgaaguagagugcaugaccuguaacggagaguccuaccggggaccaauggaccauaccgaaucgggaaaaacuugccaacgaugggaucaacaaacaccccaucgucacaaauuccuaccggaacgauacccagacaaaggauucgacgacaacuacugcagaaaucccgacgguaaacccagaccuuggugcuacacccuagaccccgacaccccaugggaauacugcgccauaaagaccugcgcacacucugccgucaacgagaccgacguccccauggaaacaaccgaaugcauacaggggcagggagagggcuaccgcggcaccagcaacaccaucuggaacgguauacccugccagcgaugggacagccaauacccccacaagcacgacauaaccccugagaacuucaagugcaaagaccuacgcgaaaacuacugccgaaacccagacggcgccgaaucaccaugguguuucacaacagacccaaacauccgcgucggcuacugcucccaaauacccaaaugcgacgucaguuccggacaagacugcuaccgaggcaacggaaagaacuacaugggaaaccucuccaaaacccguagcgguuuaacaugcuccaugugggacaagaacauggaagaccuacacagacauauauucugggaacccgacgcaagcaaacucaacaaaaauuacugccgcaaccccgacgacgaugcccauggccccuggugcuacaccggcaacccccugauccccugggacuacuguccaauaagccgaugcgagggggacaccaccccuaccaucgucaaccuggaccaccccgucaucuccugcgcaaaaaccaaacagcuccgaguagugaacggcaucccaacccagacaacggucggauggauggucucacuaaaauaccgaaacaaacacauaugcgguggaucccucaucaaagaaagcugggucuuaaccgcccgccaaugcuuccccgcacgaaacaaagaccuaaaagacuacgaagcauggcuaggcauccacgacguacacgaacgaggcgaagaaaaacgaaagcaaauccucaacaucucacaguuagucuacggaccagaagguucagaccucgugcuccuaaaguuagcccgccccgccauacuagacaacuucgucagcaccaucgaccuaccaucauacggaugcaccauaccagagaaaaccacaugcaguaucuacggcuggggcuacacgggccucaucaacgccgacggccuccuacgcguagcccaccucuauaucaugggcaacgaaaaaugcucacaacaccaccaagggaaaguaacacugaacgaauccgagcucugcgccggcgccgagaaaaucggauccggccccugcgaaggagacuacgggggaccacuaauaugcgaacagcacaagaugcgaaugguccucggagucaucguacccggccgaggcugcgcaauacccaaucgccccggcauauucguucgcguagccuacuacgcuaaauggauccacaaagucauacucaccuacaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1988 - RNA, 894 nt, Artificial Sequence
  mRNA product Design4 comprising derived and/or modified sequence from Homo sapiens__NP_005253.3__HsGFER (opt9)
gggagagucccgcagucggcguccagcggcucugcuuguucgugugugugucguugcaggccuuauucaagcuuaccauggcagcacccggcgaacgcggacgauuccacggcggcaaccucuucuuccuccccggcggcgccagauccgaaaugauggacgaccuagccacagacgccagaggccgaggcgccggaagacgcgacgcagccgccagcgcaagcacacccgcccaagcccccaccagcgacagcccaguagcagaagacgccucacgccgccgacccugccgagcaugcgucgacuucaaaaccuggaugagaacccaacaaaaacgcgacaccaaauucagagaagacugcccacccgaccgcgaagaacucggccgacacucaugggcaguccuacacacacucgcagccuacuacccagaccuccccacacccgaacaacaacaagacauggcccaauucauccaccucuucagcaaauucuacccaugcgaagaaugcgcagaagaucucagaaaacggcucugccgcaaccacccagacacccgcacccgcgccugcuucacccaauggcucugccaccuccacaacgaaguaaaccgaaaacucggaaaacccgacuucgacugcagcaaagucgacgaacgauggcgagacggcuggaaagacggaagcugcgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1989 - RNA, 906 nt, Artificial Sequence
  mRNA product Design4 comprising derived and/or modified sequence from Homo sapiens__NP_061986.1__HsFGF21(L126R,P199G,A208E) (opt11)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgcaugccaagcccaccccauacccgacuccucaccccuccuccaauucggcggccaaguccgccaacgcuaccuauacaccgacgacgcccaacaaacagaagcccaccucgaaauccgagaagacggcacagucggcggcgccgccgaccaaagccccgaaucccuccuccaacucaaagcccucaaacccggcgucauccaaauccucggcgucaaaacaucccgcuuccuaugccaacgccccgacggcgcccucuacggcucacuccacuucgaccccgaagccugcuccuuccgcgaacgccuccucgaagacggcuacaacgucuaccaauccgaagcccacggccuaccccuacaccuccccggcaacaaauccccucaccgcgaccccgcaccccgcggccccgcccgcuuccuaccccuccccggccucccccccgcccuacccgaaccccccggcauccucgccccccaacccccagacgucggcuccucugacccccucuccauggucggcggcucccaaggccgcucacccuccuacgaauccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1990 - RNA, 2463 nt, Artificial Sequence
  mRNA product Design4 comprising derived and/or modified sequence from Homo sapiens__NP_000592.3__HsHGF (opt11)
gggagagucccgcagucggcguccagcggcucugcuuguucgugugugugucguugcaggccuuauucaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1991 - RNA, 2463 nt, Artificial Sequence
  mRNA product Design4 comprising derived and/or modified sequence from Mus musculus__NP_001276387.1__MmHGF (opt11)
gggagagucccgcagucggcguccagcggcucugcuuguucgugugugugucguugcaggccuuauucaagcuuaccaugauguggggaacaaaauuacuaccaguccuacuacuccaacacguccuacuccaccuacuacuacuccacgucgcaauccccuacgccgaaggacagaaaaagcgaagaaacacacuacacgaauuuaagaaaucagccaaaaccacccuaaccaaagaagacccccuacugaaaaucaaaacuaagaaagucaacuccgcagaugagugcgcaaaccgaugcauacgcaaccgcggcuucacauucacuugcaaagccuucguuuucgacaaaucacgaaaacgcugcuacugguaccccuuuaacucgaugagcucaggcgugaagaaaggcuucggccaugaguucgaccuauacgaaaauaaagauuacauacguaacugcaucaucggaaaagguggcagcuacaaaggcacugucucaauaacgaaaaguggcaucaaaugccaacccuggaacuccaugaucccucacgaacacucauuccuccccuccagcuacagagggaaagaccuacaagaaaacuacugccguaauccaagaggagaagaaggcggaccuuggugcuucaccuccaaccccgaaguaagauacgaagugugcgacauaccacaaugcuccgaagucgaaugcaugaccugcaacggcgaauccuaccgaggacccauggaccacaccgaaucagguaagaccugccaacgcugggaccaacaaacaccccacagacacaaauuccucccugaacgcuaccccgacaaaggcuucgacgacaacuacugcaggaacccagacgguaaaccccgacccugguguuacacccucgacccagauacacccugggaauacugcgccauaaaaacaugcgcacacuccgccgucaacgagacagacguccccauggaaaccaccgagugcauacaaggacaaggggaaggauacagaggaacaucaaacaccauuuggaacggcauacccugccaaagaugggacucccaguauccccacaaacacgacaucacaccagaaaacuucaaaugcaaggaccuacgagaaaacuacugccgcaacccagacggagcugaaucccccuggugcuucacaacagacccgaauauccgcgucggauacuguucgcaaaucccaaagugcgacgucagcucaggacaagacugcuacagaggaaacggcaagaacuauaugggcaaccuuucgaaaacacgcagcggccuaaccugcuccaugugggacaagaacauggaagaccuccaccggcacauauucugggaacccgacgcaaguaaacuuaacaaaaacuacugucgcaauccggacgacgacgcccacggcccuuggugcuacaccgguaacccccuaaucccgugggacuacugccccauaucccgaugcgaaggagauacaacacccaccaucgugaaccuagaccaccccgucaucucaugcgcuaaaacgaaacagcuccgagucgucaacggcaucccaacgcaaacgaccgucggauggauggucucccugaaauaccgcaacaaacacauaugcggcggaagccuaauaaaagaaagcuggguccuuacagcccggcaaugcuucccagcccguaacaaagaccucaaagacuacgaagccuggcucggcauccacgacguacaugaacgaggggaagaaaaacgcaaacaaauacucaacaucucccagcugguauacggcccggaaggaagcgaccucguccucuugaaacuagccagacccgccauacuagacaacuucgucagcaccaucgaccuccccucauacggcugcaccaucccagaaaagacaaccugcucaaucuacggcuggggcuacaccggacuaaucaacgccgacggacuccugcgggucgcccauuuguacaucaugggaaacgaaaaaugcucccaacaccaccaaggcaaagucacccugaacgaauccgaacucugcgcaggcgccgagaaaaucggaucaggacccugcgaaggggacuacgggggcccccucaucugcgagcaacauaaaaugcguauggugcuaggcgugaucguccccggacgcggaugcgccaucccgaaccgccccgggaucuucguccgcgucgccuacuacgccaaauggauacauaaagucauucucaccuacaagcuguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1992 - RNA, 894 nt, Artificial Sequence
  mRNA product Design4 comprising derived and/or modified sequence from Homo sapiens__NP_005253.3__HsGFER (opt11)
gggagagucccgcagucggcguccagcggcucugcuuguucgugugugugucguugcaggccuuauucaagcuuaccauggcagcaccaggcgaacgcggacgcuuccacggaggcaaccuauucuuccuacccggaggcgcacgcucagaaaugauggacgaccuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacacucgcggccuacuacccagaccuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaauggcuaugccaccuacacaacgaaguaaaccgcaaacucggaaaaccagacuucgacugcagcaaagucgacgaaagguggagagacggauggaaagacggaagcugcgacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1993 - RNA, 906 nt, Artificial Sequence
  mRNA product Design4 comprising derived and/or modified sequence from Homo sapiens__NP_061986.1__HsFGF21(L126R,P199G,A208E) (opt12)
gggagagucccgcagucggcguccagcggcucugcuuguucgugugugugucguugcaggccuuauucaagcuuaccauggacucugacgaaacagguuucgaacacucaggacuaugggucucaguauuagcaggacuauuauuaggagcaugucaagcacauccaauaccagacucaucaccacuacuacaauucggcggacaaguaagacaaagauacuuauacacagacgaugcacaacaaacagaagcacauuuagaaauaagagaagauggcacaguaggcggagcagcagaccaaucaccagaaucacuauuacaauuaaaagcauuaaaaccaggaguaauacaaauauuaggaguaaaaacaucaagauucuuaugucaaagaccugacggagcacuauacggaucacuacacuuugacccagaagcaugcucauuuagagaaagauuauuagaagacggauacaauguauaucaaucagaagcacacggauuaccauuacacuuacccggaaauaaaucaccacauagagacccagcaccaagaggaccugcaagauuucuaccucuaccaggacuaccaccagcacuaccugaaccaccaggaauauuagcaccacaaccaccagacguaggauccucagaccccuuaucaaugguaggcggaucacaaggaagaucaccaucauaugaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1994 - RNA, 2463 nt, Artificial Sequence
  mRNA product Design4 comprising derived and/or modified sequence from Homo sapiens__NP_000592.3__HsHGF (opt12)
gggagagucccgcagucggcguccagcggcucugcuuguucgugugugugucguugcaggccuuauucaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1995 - RNA, 2463 nt, Artificial Sequence
  mRNA product Design4 comprising derived and/or modified sequence from Mus musculus__NP_001276387.1__MmHGF (opt12)
gggagagucccgcagucggcguccagcggcucugcuuguucgugugugugucguugcaggccuuauucaagcuuaccaugauguggggaacuaaauuacuaccaguucuauuacuucaacacguccuauuacauuuauuacuauuacacguugcaauaccauaugcagaaggacaaaaaaaaagaaggaacaccuuacacgaauuuaaaaaaucggcaaaaacaacccucacaaaggaagacccacuauuaaaaaucaaaacaaaaaaagugaauagugcagacgaaugugcaaauagaugcauaagaaacagaggauuuacauucacuuguaaagcauuuguauuugauaaaucaaggaaaagguguuauugguauccuuuuaacucaaugucuaguggaguaaaaaaaggauucggacaugaauuugaccuauaugaaaauaaagacuauauaagaaauugcauaauaggaaaagguggaucauauaaagggacaguuagcauaaccaaaucaggcauaaaaugucaaccauggaauucaaugauaccacaugaacauuccuuucuaccuaguaguuaucguggaaaagauuuacaagaaaauuauuguagaaacccaagaggagaagaaggagggccauggugcuuuacaagcaacccagaagucagauaugaaguaugugacauaccacaauguucagaaguagaauguaugacaugcaauggagaaucguauagagguccaauggaccauacagaaucaggaaaaacaugucaaagaugggaucaacaaaccccacaucgacauaaauucuuaccagaacgauauccagacaaaggguucgacgauaauuauugcagaaauccagaugggaaaccaagacccugguguuacacucuagaccccgauacaccaugggaauauugugcaauaaaaacaugcgcacacucagcaguaaaugagacugaugucccaauggaaacuacagaaugcauucaaggacaaggugaagguuaccgaggcacaaguaauacuauauggaaugggauaccaugucaaagaugggacagucaauacccacauaaacaugauauaacgccagaaaauuuuaaauguaaagauuuaagagaaaauuauugcagaaauccugauggcgcggaaaguccauggugcuucacaacugauccuaacauaagaguugguuauugcagucaaauaccuaaaugcgauguaucauccggacaagauuguuauagggguaauggaaaaaauuauaugggcaauuuaucaaaaacacguaguggauuaacauguucaaugugggauaaaaauauggaagauuuacaucgacacauuuucugggaacccgaugcuaguaaauuaaacaaaaacuauugucgaaacccagaugaugaugcacauggaccauggugcuauacagguaacccacuuauaccaugggacuauuguccuauaucaagaugugaaggcgauacaacaccuacuauagucaauuuagaucauccuguaaucaguugcgcuaaaacaaaacaauuaagaguuguaaacggaauuccaacacaaacaacaguaggauggaugguaucacucaaauaccgaaauaaacacauaugcggagguucuuuaauaaaagaaagcuggguauuaaccgcaagacaaugcuucccggcaagaaauaaagauuuaaaagauuaugaagcaugguuaggaauacacgauguacacgaaaggggagaagaaaaaagaaaacaaauacuaaauauaucacaauuaguauacggcccagaagggagcgaucuaguucuucuaaaauuagccagaccagcaauauuagauaauuuuguaucuacuaucgaucuaccaucauauggauguacaauaccugagaaaacaacauguucaauauauggauggggauauacuggauuaauaaacgccgauggacuucuuagaguagcacacuuauauauaaugggaaacgaaaaaugcucacaacaucaucaaggaaaaguuacacuaaacgaaucagaacuaugugcuggcgcagaaaaaaucggaucaggcccaugcgaaggugauuacggcggaccacuuauaugugaacaacauaaaaugcgcaugguauuaggagucauaguucccggucggggcugugcgauaccaaacagaccaggcauauuuguccguguagccuacuaugcaaaauggauacauaaaguaauauuaacauauaaauuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1996 - RNA, 894 nt, Artificial Sequence
  mRNA product Design4 comprising derived and/or modified sequence from Homo sapiens__NP_005253.3__HsGFER (opt12)
gggagagucccgcagucggcguccagcggcucugcuuguucgugugugugucguugcaggccuuauucaagcuuaccauggcugcaccaggagaaagaggaagauuucauggaggaaauuuauucuuuuuaccaggaggagcaagaagugaaaugauggaugauuuagcaacagaugcaagaggaagaggagcaggaagaagagaugcagcagcaagugcaaguacaccagcacaagcaccaacaagugauaguccaguagcagaagaugcaaguagaagaagaccauguagagcauguguagauuuuaaaacauggaugagaacacaacaaaagagagauacaaaauuuagagaagauuguccaccagauagagaagaacuaggaagacauaguugggcaguacuacauacacuagcagcauauuauccagauuuaccaacaccagaacaacaacaagauauggcacaauuuauacauuuauuuaguaaauuuuacccaugugaagaaugugcggaagauuuaagaaaaagauuauguagaaaucauccagauacaagaacaagagcauguuuuacucaaugguuaugucauuuacauaaugaaguaaauagaaaauuaggaaaaccagauuuugauuguaguaaaguagaugaaagauggagagacggauggaaagauggaaguugugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1997 - RNA, 906 nt, Artificial Sequence
  mRNA product Design4 comprising derived and/or modified sequence from Homo sapiens__NP_061986.1__HsFGF21(L126R,P199G,A208E) (opt13)
gggagagucccgcagucggcguccagcggcucugcuuguucgugugugugucguugcaggccuuauucaagcuuaccauggacucagacgaaacaggauuugaacacucaggacuauggguaucaguacuagcaggauuauuacuaggagccugccaagcacacccaauaccagacucaucaccauuauuacaauucggaggacaaguuagacaaagauaucuauauacagaugacgcacaacaaacagaagcacacuuagaaauaagagaagacggaacaguaggaggagcagcagaccaaucaccagaaucccuacuacaauuaaaagcacuaaaaccaggaguaauacaaauauuaggaguaaaaacaucaagauuccuaugccaaagaccagacggagcacuauacggcucacuacacuuugacccagaagcaugcucauucagagaaagacuacuagaagacggauauaauguauaucaaucagaagcacacggacuaccuuuacauuuaccaggaaacaaaucaccacacagagacccagcaccaagaggcccagcacgcuuuuuaccauuaccaggacuaccaccagcauuaccagaaccaccaggaauacuagcaccacaaccaccagauguuggaagcucagacccacuaucaaugguaggaggaucacaaggaagaucaccaucauaugaaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1998 - RNA, 2463 nt, Artificial Sequence
  mRNA product Design4 comprising derived and/or modified sequence from Homo sapiens__NP_000592.3__HsHGF (opt13)
gggagagucccgcagucggcguccagcggcucugcuuguucgugugugugucguugcaggccuuauucaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1999 - RNA, 2463 nt, Artificial Sequence
  mRNA product Design4 comprising derived and/or modified sequence from Mus musculus__NP_001276387.1__MmHGF (opt13)
gggagagucccgcagucggcguccagcggcucugcuuguucgugugugugucguugcaggccuuauucaagcuuaccaugauguggggaacaaaacuuuuaccuguucuauuauuacaacacguccuguuacacuuauuauuacuacauguagccauaccuuacgcagaaggacaaaagaaacgaagaaacacacuucaugaauuuaagaaauccgcaaaaacaacauuaacaaaagaagauccauuauuaaaaauaaaaacaaagaaaguuaauucagcagaugaaugugcaaauagauguauaagaaacagaggauuuaccuuuacauguaaagcauuuguauucgacaaaucaaggaaacgauguuacugguauccauucaauaguaugaguucuggaguaaagaaaggauucggucaugaguucgaccuauaugaaaauaaagacuauauuagaaauuguauaaucggcaaaggugggucuuauaaaggcacuguuaguauaacaaaaucaggaauaaaaugucaaccauggaauagcaugauaccacacgaacacucauuucucccaucuucauacaggggcaaagaccuacaagaaaauuauuguagaaacccaaggggagaagaaggaggcccaugguguuuuacaucgaauccugaaguacgauaugaaguaugugacaucccccaaugcagugaaguagaauguaugacuuguaauggugaaucauaccgaggaccuauggaccauacagaaucaggaaaaacuugccaacgaugggaucaacaaaccccucaucgacacaaauuuuuaccagaacguuacccagauaaaggauuugacgauaauuacuguagaaauccagacgguaaaccucgacccugguguuacacucuugauccagauacaccaugggaauauugcgcaauaaaaacuugcgcacauucugcaguaaaugaaacagacguuccaauggaaacuaccgaauguauacaaggccaaggagaaggcuauagagguacaucaaauacaauauggaauggcauacccugccaaaggugggacucucaauauccacauaaacaugauauaacaccagaaaacuuuaaauguaaagauuuaagagaaaauuacuguagaaauccggauggagcagaaucucccugguguuucacuaccgauccuaacauaagaguaggauauuguagccaaauaccuaaaugugauguuagcucaggucaagacugcuacagagguaauggcaaaaauuacauggggaaucucaguaaaacacguaguggacucacauguucaaugugggauaaaaauauggaagaccugcacagacauauauucugggaaccugaugcuucaaaauuaaauaaaaauuauugcagaaauccagaugaugacgcucacggaccaugguguuacacugguaauccauuaauaccaugggauuauuguccaauaucaagaugcgaaggugauacaacuccaacaauaguaaaucuagaucauccaguaauauccugugcaaaaacaaaacaacuaagaguaguaaacggaauaccaacacaaacaacaguaggauggaugguuaguuuaaaauacagaaauaaacauauauguggaggauccuuaauaaaagaaucauggguauuaacugcaagacaauguuucccagcaaggaacaaagauuuaaaagauuacgaagcauggcuaggaauacaugauguucacgaaagaggagaagaaaaacguaaacaaauuuugaacauuucacaacuuguauacggcccagaaggaucugauuuaguauuauuaaaguuagcaagaccagcaauucucgauaauuucguaucaacgauagaucuccccaguuacggcuguacgauaccagaaaagacaacaugcaguauauacggauggggauauacaggacuaaucaacgcagauggacuuuuaagaguagcccacuuauauauaauggguaacgaaaaauguucacaacaucaucaaggaaaaguaacacuaaaugaaagcgaauuaugugcaggcgcagagaaaauaggaagcggaccuugugaaggcgauuacgguggaccacuaauaugugaacaacauaaaaugagaaugguauuaggaguaauaguuccaggacguggaugugccauaccaaaccgaccaggaauauuuguuaggguagccuacuacgcaaaauggauucacaaaguaauauuaacauauaaacuauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2000 - RNA, 894 nt, Artificial Sequence
  mRNA product Design4 comprising derived and/or modified sequence from Homo sapiens__NP_005253.3__HsGFER (opt13)
gggagagucccgcagucggcguccagcggcucugcuuguucgugugugugucguugcaggccuuauucaagcuuaccauggcggcaccaggagaaagaggaagauuucaugguggaaauuuauucuuuuuaccaggaggagcaagaucagaaaugauggaugacuuagcaacggaugcaagaggaagaggagcaggaagaagagaugcagcagcaucagcaucaacaccagcacaagcaccaacaagcgauaguccaguagcagaagaugcaagcagaagaagaccauguagagcauguguagauuuuaaaacauggaugagaacacaacaaaaacgagacacaaaauuuagagaagauuguccaccagauagagaagaauuaggaagacacucaugggcaguauuacauacauuagcagcauauuauccagaucuaccaacaccagaacaacaacaagauauggcacaauuuauacauuuauuuucaaaauuuuauccaugugaagaaugugcagaagaucuaagaaaaagacuauguagaaaucauccagauacaagaacaagagcauguuuuacacaaugguuaugucacuuacacaacgaaguaaauagaaaauuaggaaaaccagauuuugauuguaguaaaguagaugaaagauggagagauggauggaaagauggaaguugugauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2001 - RNA, 2398 nt, Artificial Sequence
  mRNA product Design5 comprising derived and/or modified sequence from Homo sapiens__NP_000592.3__HsHGF (opt1) R6258
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaa

SEQ ID NO: 2002 - RNA, 2422 nt, Artificial Sequence
  mRNA product Design6 comprising derived and/or modified sequence from Homo sapiens__NP_000592.3__HsHGF (opt1) R6259
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaa

SEQ ID NO: 2003 - RNA, 2411 nt, Artificial Sequence
  mRNA product Design7 comprising derived and/or modified sequence from Homo sapiens__NP_000592.3__HsHGF (opt1) R6260
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguguccaccugucccuccugggcugcuggauugucucguuuuccugccaaauaaacaggaucagcgcuuuacagaucuaaaaaaaaaaaaaaaaaaaaaaaaaaaaaaaaaaaaaaaaaaaaaaaaaaaaaaaaaaaaaaa

SEQ ID NO: 2004 - RNA, 2435 nt, Artificial Sequence
  mRNA product Design8 comprising derived and/or modified sequence from Homo sapiens__NP_000592.3__HsHGF (opt1) R6261
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaa

SEQ ID NO: 2005 - RNA, 2474 nt, Artificial Sequence
  mRNA product Design9 comprising derived and/or modified sequence from Homo sapiens__NP_000592.3__HsHGF (opt1) R6262
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucuaaaaaaaaaaaaaaaaaaaaaaaaaaaaaaaaaaaaaaaaaaaaaaaaaaaaaaaaaaaaaaa

SEQ ID NO: 2006 - RNA, 2498 nt, Artificial Sequence
  mRNA product Design10 comprising derived and/or modified sequence from Homo sapiens__NP_000592.3__HsHGF (opt1) R6263
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaagagcgccaagacgacccugaucaagaucgaccccgcccugaagaucaagaccaagaaggugaacaccgccgaccagugcgccaaccggugcacgcgcaacaaggggcuccccuucaccugcaaggcguucguguucgacaaggcccggaagcagugccugugguucccguucaacuccaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucacgagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccugaccuacaaggugccccagagcugaggacuaguggaagcauuuuccuggcugauuaaaagaaauuacucagcuauggucaucuguuccuguuagaaggcuaugcagcauauuauauacuaugcgcauguuaugaaaugcauaauaaaaaauuuuaaaaaaucuaaaagaucucaaaggcucuuuucagagccaccaaaaaaaaaaaaaaaaaaaaaaaaaaaaaaaaaaaaaaaaaaaaaaaaaaaaaaaaaaaaaaaa

SEQ ID NO: 2007 - RNA, 846 nt, Artificial Sequence
  derived and/or modified CDS sequence (opt10) from Homo sapiens__NP_003801.1__HsTNFSF10
auggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcuga

SEQ ID NO: 2008 - RNA, 564 nt, Artificial Sequence
  derived and/or modified CDS sequence (opt10) from Homo sapiens__NP_003801.1__HsTNFSF10(95-281)
accuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcuga

SEQ ID NO: 2009 - RNA, 1077 nt, Artificial Sequence
  derived and/or modified CDS sequence (opt10) from Homo sapiens__NP_004355.2__HsCEBPA
auggaaagcgcagacuucuacgaagcagaaccccgacccccuaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuga

SEQ ID NO: 2010 - RNA, 1035 nt, Artificial Sequence
  derived and/or modified CDS sequence (opt10) from Homo sapiens__NP_004355.2__HsCEBPA(15-358)
augucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuga

SEQ ID NO: 2011 - RNA, 1425 nt, Artificial Sequence
  derived and/or modified CDS sequence (opt10) from Homo sapiens__NP_000448.3__HsHNF4A
augcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgcuuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucuga

SEQ ID NO: 2012 - RNA, 630 nt, Artificial Sequence
  derived and/or modified CDS sequence (opt10) from Homo sapiens__NP_061986.1__HsFGF21
auggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauga

SEQ ID NO: 2013 - RNA, 1356 nt, Artificial Sequence
  derived and/or modified CDS sequence (opt10) from Homo sapiens__NP_078852.3__HsOGFRL1
auggggaauuuauuggggggcgugucguuuagggaaccgacgacggucgaagauugugauaguacguggcaaacggauagcgaaccggaaccggaggagccgggccccgggggggggucggaagggcccggccaagaaagugaacaaccggcccaaccgcccgaacaggcggggggcagaccgggggcgucgccggcccccgaugaagaugcggaagccgccggggcggaacaagggggggacaguaccgaggccaccgcgaagccgaaacgcucguucuacgccgcgcgcgaccucuauaaauauaggcaucaauauccgaauuuuaaggacauaagguaccagaacgaucucucgaacuugagguucuacaaaaacaagaucccguuuaaaccggacggggucuauaucgaggaggucuugucgaaguggaagggggacuacgagaaguuagaacauaaucauaccuauauccagugguuguuuccguuacgcgagcaggggcucaauuuuuacgcgaaggaguugaccaccuacgagaucgaagaguuuaagaagaccaaggaggccauccgccgcuuuuuguuagccuacaagaugauguuggaguucuucgggaucaaguuaaccgacaagaccgggaacgucgccagagccgucaauuggcaagagcgcuuccaacacuuaaacgaaagucaacauaauuaccuccgcauaaccaggaucuugaagucguugggggaauugggguacgagucguucaagagcccguuggucaaguucaucuugcacgaggccuuggucgaaaacaccaucccgaacaucaaacaaucggccuuggaauacuucgucuacaccauccgcgaucgccgcgagcgccgcaaauuguuaagauuugcgcaaaagcauuauaccccgagcgaaaauuucauaugggggcccccgaggaaggagcaaagcgaagggucgaaggcgcaaaagaugagcaguccguuggcgaguucgcacaauucgcagaccagcaugcauaagaaggcgaaagauaguaagaacaguaguagcgccguccaccucaacucgaagaccgccgaggauaagaaggucgccccgaaggaaccggucgaggaaaccgaucgcccgucgccggaaccgucgaacgaggccgcgaaaccgcgcaacaccgaaaaagauucgaacgccgaaaauaugaacagccagccggaaaagaccgucaccaccccgaccgagaagaaagaaucggucagcccggaaaacaaugaggagggggggaacgacaaucaggauaacgagaacccggggaacaccaacugucacgacgucgucuugguccaauga

SEQ ID NO: 2014 - RNA, 558 nt, Artificial Sequence
  derived and/or modified CDS sequence (opt10) from Homo sapiens__NP_008842.1__HsRLN1
augccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgcaccccaaacuccccgccccgucgccgagaucguccccuccuucaucaacaaagacaccgaaaccaucaucaucaugcucgaauuuaucgccaaccucccucccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugcuuaaucggcugcaccaaacgcucccucgccaaauacugcuga

SEQ ID NO: 2015 - RNA, 558 nt, Artificial Sequence
  derived and/or modified CDS sequence (opt10) from Homo sapiens__NP_604390.1__HsRLN2
augccgagguuauucuucuuucauuuauugggggugugccucuuguuaaaucaguucagucgcgccguggccgauagcuggauggaagaggucaucaagcucugugggagggagcucgucagggcccaaaucgcgaucugugggaugucgacguggucgaagcgcagcuuaucgcaagaggacgccccgcaaaccccgcgcccggucgccgagaucgucccgaguuuuauaaauaaggacaccgagacgaucaacaugaugagcgaguucgucgccaaccucccgcaagaauuaaaacucacguuaagcgaaaugcaaccggcccucccgcaauugcagcagcacgucccgguccucaaggacaguucguuguuguucgaggaguucaaaaaguugaucaggaaccgccagucggaggcggccgauucgucgccgagcgagcucaaguaucucgggcucgacacccacagcaggaagaaacgccaguuguauucggcccucgccaacaagugcugucacgucgggugcacgaagcgcagcuuggcccgcuucuguuga

SEQ ID NO: 2016 - RNA, 429 nt, Artificial Sequence; identical to SEQ ID NO: 342
  derived and/or modified CDS sequence (opt10) from Homo sapiens__NP_543140.1__HsRLN3

SEQ ID NO: 2017 - RNA, 1410 nt, Artificial Sequence
  derived and/or modified CDS sequence (opt10) from Homo sapiens__NP_002412.1__HsMMP1
augcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacuga

SEQ ID NO: 2018 - RNA, 3066 nt, Artificial Sequence; identical to SEQ ID NO: 349
  derived and/or modified CDS sequence (opt10) from Clostridium histolyticum__BAA34542.1__ColH

SEQ ID NO: 2019 - RNA, 2187 nt, Artificial Sequence
  derived and/or modified CDS sequence (opt10) from Homo sapiens__NP_000592.3__HsHGF
augugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcuga

SEQ ID NO: 2020 - RNA, 618 nt, Artificial Sequence
  derived and/or modified CDS sequence (opt10) from Homo sapiens__NP_005253.3__HsGFER
auggcagcaccaggcgaacgcggacgcuuccacggaggcaaccuauucuucuuacccggaggcgcacgcucagaaaugauggacgacuuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacauuagcggcguacuauccagaucuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaaugguuaugccacuuacacaacgaaguaaaccgcaaacucggaaaaccagacuucgacugcagcaaagucgacgaaagguggagagacggauggaaagacggaagcugcgacuga

SEQ ID NO: 2021 - RNA, 1063 nt, Artificial Sequence
  mRNA product Design1 comprising derived and/or modified sequence from Homo sapiens__NP_003801.1__HsTNFSF10 (opt10)
gggagaaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2022 - RNA, 784 nt, Artificial Sequence
  mRNA product Design1 comprising derived and/or modified sequence from Homo sapiens__NP_003801.1__HsTNFSF10(95-281) (opt10)
gggagaaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2023 - RNA, 1294 nt, Artificial Sequence
  mRNA product Design1 comprising derived and/or modified sequence from Homo sapiens__NP_004355.2__HsCEBPA (opt10)
gggagaaagcuuaccauggaaagcgcagacuucuacgaagcagaaccccgacccccuaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2024 - RNA, 1252 nt, Artificial Sequence
  mRNA product Design1 comprising derived and/or modified sequence from Homo sapiens__NP_004355.2__HsCEBPA(15-358) (opt10)
gggagaaagcuuaccaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2025 - RNA, 1642 nt, Artificial Sequence
  mRNA product Design1 comprising derived and/or modified sequence from Homo sapiens__NP_000448.3__HsHNF4A (opt10)
gggagaaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgcuuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2026 - RNA, 847 nt, Artificial Sequence
  mRNA product Design1 comprising derived and/or modified sequence from Homo sapiens__NP_061986.1__HsFGF21 (opt10)
gggagaaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2027 - RNA, 1573 nt, Artificial Sequence
  mRNA product Design1 comprising derived and/or modified sequence from Homo sapiens__NP_078852.3__HsOGFRL1 (opt10)
gggagaaagcuuaccauggggaauuuauuggggggcgugucguuuagggaaccgacgacggucgaagauugugauaguacguggcaaacggauagcgaaccggaaccggaggagccgggccccgggggggggucggaagggcccggccaagaaagugaacaaccggcccaaccgcccgaacaggcggggggcagaccgggggcgucgccggcccccgaugaagaugcggaagccgccggggcggaacaagggggggacaguaccgaggccaccgcgaagccgaaacgcucguucuacgccgcgcgcgaccucuauaaauauaggcaucaauauccgaauuuuaaggacauaagguaccagaacgaucucucgaacuugagguucuacaaaaacaagaucccguuuaaaccggacggggucuauaucgaggaggucuugucgaaguggaagggggacuacgagaaguuagaacauaaucauaccuauauccagugguuguuuccguuacgcgagcaggggcucaauuuuuacgcgaaggaguugaccaccuacgagaucgaagaguuuaagaagaccaaggaggccauccgccgcuuuuuguuagccuacaagaugauguuggaguucuucgggaucaaguuaaccgacaagaccgggaacgucgccagagccgucaauuggcaagagcgcuuccaacacuuaaacgaaagucaacauaauuaccuccgcauaaccaggaucuugaagucguugggggaauugggguacgagucguucaagagcccguuggucaaguucaucuugcacgaggccuuggucgaaaacaccaucccgaacaucaaacaaucggccuuggaauacuucgucuacaccauccgcgaucgccgcgagcgccgcaaauuguuaagauuugcgcaaaagcauuauaccccgagcgaaaauuucauaugggggcccccgaggaaggagcaaagcgaagggucgaaggcgcaaaagaugagcaguccguuggcgaguucgcacaauucgcagaccagcaugcauaagaaggcgaaagauaguaagaacaguaguagcgccguccaccucaacucgaagaccgccgaggauaagaaggucgccccgaaggaaccggucgaggaaaccgaucgcccgucgccggaaccgucgaacgaggccgcgaaaccgcgcaacaccgaaaaagauucgaacgccgaaaauaugaacagccagccggaaaagaccgucaccaccccgaccgagaagaaagaaucggucagcccggaaaacaaugaggagggggggaacgacaaucaggauaacgagaacccggggaacaccaacugucacgacgucgucuugguccaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2028 - RNA, 775 nt, Artificial Sequence
  mRNA product Design1 comprising derived and/or modified sequence from Homo sapiens__NP_008842.1__HsRLN1 (opt10)
gggagaaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgcaccccaaacuccccgccccgucgccgagaucguccccuccuucaucaacaaagacaccgaaaccaucaucaucaugcucgaauuuaucgccaaccucccucccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugcuuaaucggcugcaccaaacgcucccucgccaaauacugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2029 - RNA, 775 nt, Artificial Sequence
  mRNA product Design1 comprising derived and/or modified sequence from Homo sapiens__NP_604390.1__HsRLN2 (opt10)
gggagaaagcuuaccaugccgagguuauucuucuuucauuuauugggggugugccucuuguuaaaucaguucagucgcgccguggccgauagcuggauggaagaggucaucaagcucugugggagggagcucgucagggcccaaaucgcgaucugugggaugucgacguggucgaagcgcagcuuaucgcaagaggacgccccgcaaaccccgcgcccggucgccgagaucgucccgaguuuuauaaauaaggacaccgagacgaucaacaugaugagcgaguucgucgccaaccucccgcaagaauuaaaacucacguuaagcgaaaugcaaccggcccucccgcaauugcagcagcacgucccgguccucaaggacaguucguuguuguucgaggaguucaaaaaguugaucaggaaccgccagucggaggcggccgauucgucgccgagcgagcucaaguaucucgggcucgacacccacagcaggaagaaacgccaguuguauucggcccucgccaacaagugcugucacgucgggugcacgaagcgcagcuuggcccgcuucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2030 - RNA, 646 nt, Artificial Sequence; identical to SEQ ID NO: 691
  mRNA product Design1 comprising derived and/or modified sequence from Homo sapiens__NP_543140.1__HsRLN3  (opt10)

SEQ ID NO: 2031 - RNA, 1627 nt, Artificial Sequence
  mRNA product Design1 comprising derived and/or modified sequence from Homo sapiens__NP_002412.1__HsMMP1 (opt10)
gggagaaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2032 - RNA, 3283 nt, Artificial Sequence; identical to SEQ ID NO: 698
  mRNA product Design1 comprising derived and/or modified sequence from Clostridium histolyticum__BAA34542.1__ColH (opt10)

SEQ ID NO: 2033 - RNA, 2404 nt, Artificial Sequence
  mRNA product Design1 comprising derived and/or modified sequence from Homo sapiens__NP_000592.3__HsHGF (opt10)
gggagaaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2034 - RNA, 835 nt, Artificial Sequence
  mRNA product Design1 comprising derived and/or modified sequence from Homo sapiens__NP_005253.3__HsGFER (opt10)
gggagaaagcuuaccauggcagcaccaggcgaacgcggacgcuuccacggaggcaaccuauucuucuuacccggaggcgcacgcucagaaaugauggacgacuuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacauuagcggcguacuauccagaucuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaaugguuaugccacuuacacaacgaaguaaaccgcaaacucggaaaaccagacuucgacugcagcaaagucgacgaaagguggagagacggauggaaagacggaagcugcgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2035 - RNA, 1228 nt, Artificial Sequence
  mRNA product Design2 comprising derived and/or modified sequence from Homo sapiens__NP_003801.1__HsTNFSF10 (opt10)
ggggcgcugccuacggagguggcagccaucuccuucucggcaucaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2036 - RNA, 949 nt, Artificial Sequence
  mRNA product Design2 comprising derived and/or modified sequence from Homo sapiens__NP_003801.1__HsTNFSF10(95-281) (opt10)
ggggcgcugccuacggagguggcagccaucuccuucucggcaucaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2037 - RNA, 1459 nt, Artificial Sequence
  mRNA product Design2 comprising derived and/or modified sequence from Homo sapiens__NP_004355.2__HsCEBPA (opt10)
ggggcgcugccuacggagguggcagccaucuccuucucggcaucaagcuuaccauggaaagcgcagacuucuacgaagcagaaccccgacccccuaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2038 - RNA, 1417 nt, Artificial Sequence
  mRNA product Design2 comprising derived and/or modified sequence from Homo sapiens__NP_004355.2__HsCEBPA(15-358) (opt10)
ggggcgcugccuacggagguggcagccaucuccuucucggcaucaagcuuaccaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2039 - RNA, 1807 nt, Artificial Sequence
  mRNA product Design2 comprising derived and/or modified sequence from Homo sapiens__NP_000448.3__HsHNF4A (opt10)
ggggcgcugccuacggagguggcagccaucuccuucucggcaucaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgcuuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2040 - RNA, 1012 nt, Artificial Sequence
  mRNA product Design2 comprising derived and/or modified sequence from Homo sapiens__NP_061986.1__HsFGF21 (opt10)
ggggcgcugccuacggagguggcagccaucuccuucucggcaucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2041 - RNA, 1738 nt, Artificial Sequence
  mRNA product Design2 comprising derived and/or modified sequence from Homo sapiens__NP_078852.3__HsOGFRL1 (opt10)
ggggcgcugccuacggagguggcagccaucuccuucucggcaucaagcuuaccauggggaauuuauuggggggcgugucguuuagggaaccgacgacggucgaagauugugauaguacguggcaaacggauagcgaaccggaaccggaggagccgggccccgggggggggucggaagggcccggccaagaaagugaacaaccggcccaaccgcccgaacaggcggggggcagaccgggggcgucgccggcccccgaugaagaugcggaagccgccggggcggaacaagggggggacaguaccgaggccaccgcgaagccgaaacgcucguucuacgccgcgcgcgaccucuauaaauauaggcaucaauauccgaauuuuaaggacauaagguaccagaacgaucucucgaacuugagguucuacaaaaacaagaucccguuuaaaccggacggggucuauaucgaggaggucuugucgaaguggaagggggacuacgagaaguuagaacauaaucauaccuauauccagugguuguuuccguuacgcgagcaggggcucaauuuuuacgcgaaggaguugaccaccuacgagaucgaagaguuuaagaagaccaaggaggccauccgccgcuuuuuguuagccuacaagaugauguuggaguucuucgggaucaaguuaaccgacaagaccgggaacgucgccagagccgucaauuggcaagagcgcuuccaacacuuaaacgaaagucaacauaauuaccuccgcauaaccaggaucuugaagucguugggggaauugggguacgagucguucaagagcccguuggucaaguucaucuugcacgaggccuuggucgaaaacaccaucccgaacaucaaacaaucggccuuggaauacuucgucuacaccauccgcgaucgccgcgagcgccgcaaauuguuaagauuugcgcaaaagcauuauaccccgagcgaaaauuucauaugggggcccccgaggaaggagcaaagcgaagggucgaaggcgcaaaagaugagcaguccguuggcgaguucgcacaauucgcagaccagcaugcauaagaaggcgaaagauaguaagaacaguaguagcgccguccaccucaacucgaagaccgccgaggauaagaaggucgccccgaaggaaccggucgaggaaaccgaucgcccgucgccggaaccgucgaacgaggccgcgaaaccgcgcaacaccgaaaaagauucgaacgccgaaaauaugaacagccagccggaaaagaccgucaccaccccgaccgagaagaaagaaucggucagcccggaaaacaaugaggagggggggaacgacaaucaggauaacgagaacccggggaacaccaacugucacgacgucgucuugguccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2042 - RNA, 940 nt, Artificial Sequence
  mRNA product Design2 comprising derived and/or modified sequence from Homo sapiens__NP_008842.1__HsRLN1 (opt10)
ggggcgcugccuacggagguggcagccaucuccuucucggcaucaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgcaccccaaacuccccgccccgucgccgagaucguccccuccuucaucaacaaagacaccgaaaccaucaucaucaugcucgaauuuaucgccaaccucccucccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugcuuaaucggcugcaccaaacgcucccucgccaaauacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2043 - RNA, 940 nt, Artificial Sequence
  mRNA product Design2 comprising derived and/or modified sequence from Homo sapiens__NP_604390.1__HsRLN2 (opt10)
ggggcgcugccuacggagguggcagccaucuccuucucggcaucaagcuuaccaugccgagguuauucuucuuucauuuauugggggugugccucuuguuaaaucaguucagucgcgccguggccgauagcuggauggaagaggucaucaagcucugugggagggagcucgucagggcccaaaucgcgaucugugggaugucgacguggucgaagcgcagcuuaucgcaagaggacgccccgcaaaccccgcgcccggucgccgagaucgucccgaguuuuauaaauaaggacaccgagacgaucaacaugaugagcgaguucgucgccaaccucccgcaagaauuaaaacucacguuaagcgaaaugcaaccggcccucccgcaauugcagcagcacgucccgguccucaaggacaguucguuguuguucgaggaguucaaaaaguugaucaggaaccgccagucggaggcggccgauucgucgccgagcgagcucaaguaucucgggcucgacacccacagcaggaagaaacgccaguuguauucggcccucgccaacaagugcugucacgucgggugcacgaagcgcagcuuggcccgcuucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2044 - RNA, 811 nt, Artificial Sequence; identical to SEQ ID NO: 1031
  mRNA product Design2 comprising derived and/or modified sequence from Homo sapiens__NP_543140.1__HsRLN3  (opt10)

SEQ ID NO: 2045 - RNA, 1792 nt, Artificial Sequence
  mRNA product Design2 comprising derived and/or modified sequence from Homo sapiens__NP_002412.1__HsMMP1 (opt10)
ggggcgcugccuacggagguggcagccaucuccuucucggcaucaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2046 - RNA, 3448 nt, Artificial Sequence; identical to SEQ ID NO: 1038
  mRNA product Design2 comprising derived and/or modified sequence from Clostridium histolyticum__BAA34542.1__ColH (opt10)

SEQ ID NO: 2047 - RNA, 2569 nt, Artificial Sequence
  mRNA product Design2 comprising derived and/or modified sequence from Homo sapiens__NP_000592.3__HsHGF (opt10)
ggggcgcugccuacggagguggcagccaucuccuucucggcaucaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2048 - RNA, 1000 nt, Artificial Sequence
  mRNA product Design2 comprising derived and/or modified sequence from Homo sapiens__NP_005253.3__HsGFER (opt10)
ggggcgcugccuacggagguggcagccaucuccuucucggcaucaagcuuaccauggcagcaccaggcgaacgcggacgcuuccacggaggcaaccuauucuucuuacccggaggcgcacgcucagaaaugauggacgacuuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacauuagcggcguacuauccagaucuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaaugguuaugccacuuacacaacgaaguaaaccgcaaacucggaaaaccagacuucgacugcagcaaagucgacgaaagguggagagacggauggaaagacggaagcugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2049 - RNA, 1193 nt, Artificial Sequence
  mRNA product Design3 comprising derived and/or modified sequence from Homo sapiens__NP_003801.1__HsTNFSF10 (opt10)
gggagagucccgcagucggcguccagcggcucugcuuguucgugugugugucguugcaggccuuauucaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2050 - RNA, 914 nt, Artificial Sequence
  mRNA product Design3 comprising derived and/or modified sequence from Homo sapiens__NP_003801.1__HsTNFSF10(95-281) (opt10)
gggagagucccgcagucggcguccagcggcucugcuuguucgugugugugucguugcaggccuuauucaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2051 - RNA, 1424 nt, Artificial Sequence
  mRNA product Design3 comprising derived and/or modified sequence from Homo sapiens__NP_004355.2__HsCEBPA (opt10)
gggagagucccgcagucggcguccagcggcucugcuuguucgugugugugucguugcaggccuuauucaagcuuaccauggaaagcgcagacuucuacgaagcagaaccccgacccccuaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2052 - RNA, 1382 nt, Artificial Sequence
  mRNA product Design3 comprising derived and/or modified sequence from Homo sapiens__NP_004355.2__HsCEBPA(15-358) (opt10)
gggagagucccgcagucggcguccagcggcucugcuuguucgugugugugucguugcaggccuuauucaagcuuaccaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2053 - RNA, 1772 nt, Artificial Sequence
  mRNA product Design3 comprising derived and/or modified sequence from Homo sapiens__NP_000448.3__HsHNF4A (opt10)
gggagagucccgcagucggcguccagcggcucugcuuguucgugugugugucguugcaggccuuauucaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgcuuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2054 - RNA, 977 nt, Artificial Sequence
  mRNA product Design3 comprising derived and/or modified sequence from Homo sapiens__NP_061986.1__HsFGF21 (opt10)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2055 - RNA, 1703 nt, Artificial Sequence
  mRNA product Design3 comprising derived and/or modified sequence from Homo sapiens__NP_078852.3__HsOGFRL1 (opt10)
gggagagucccgcagucggcguccagcggcucugcuuguucgugugugugucguugcaggccuuauucaagcuuaccauggggaauuuauuggggggcgugucguuuagggaaccgacgacggucgaagauugugauaguacguggcaaacggauagcgaaccggaaccggaggagccgggccccgggggggggucggaagggcccggccaagaaagugaacaaccggcccaaccgcccgaacaggcggggggcagaccgggggcgucgccggcccccgaugaagaugcggaagccgccggggcggaacaagggggggacaguaccgaggccaccgcgaagccgaaacgcucguucuacgccgcgcgcgaccucuauaaauauaggcaucaauauccgaauuuuaaggacauaagguaccagaacgaucucucgaacuugagguucuacaaaaacaagaucccguuuaaaccggacggggucuauaucgaggaggucuugucgaaguggaagggggacuacgagaaguuagaacauaaucauaccuauauccagugguuguuuccguuacgcgagcaggggcucaauuuuuacgcgaaggaguugaccaccuacgagaucgaagaguuuaagaagaccaaggaggccauccgccgcuuuuuguuagccuacaagaugauguuggaguucuucgggaucaaguuaaccgacaagaccgggaacgucgccagagccgucaauuggcaagagcgcuuccaacacuuaaacgaaagucaacauaauuaccuccgcauaaccaggaucuugaagucguugggggaauugggguacgagucguucaagagcccguuggucaaguucaucuugcacgaggccuuggucgaaaacaccaucccgaacaucaaacaaucggccuuggaauacuucgucuacaccauccgcgaucgccgcgagcgccgcaaauuguuaagauuugcgcaaaagcauuauaccccgagcgaaaauuucauaugggggcccccgaggaaggagcaaagcgaagggucgaaggcgcaaaagaugagcaguccguuggcgaguucgcacaauucgcagaccagcaugcauaagaaggcgaaagauaguaagaacaguaguagcgccguccaccucaacucgaagaccgccgaggauaagaaggucgccccgaaggaaccggucgaggaaaccgaucgcccgucgccggaaccgucgaacgaggccgcgaaaccgcgcaacaccgaaaaagauucgaacgccgaaaauaugaacagccagccggaaaagaccgucaccaccccgaccgagaagaaagaaucggucagcccggaaaacaaugaggagggggggaacgacaaucaggauaacgagaacccggggaacaccaacugucacgacgucgucuugguccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2056 - RNA, 905 nt, Artificial Sequence
  mRNA product Design3 comprising derived and/or modified sequence from Homo sapiens__NP_008842.1__HsRLN1 (opt10)
gggagagucccgcagucggcguccagcggcucugcuuguucgugugugugucguugcaggccuuauucaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgcaccccaaacuccccgccccgucgccgagaucguccccuccuucaucaacaaagacaccgaaaccaucaucaucaugcucgaauuuaucgccaaccucccucccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugcuuaaucggcugcaccaaacgcucccucgccaaauacugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2057 - RNA, 905 nt, Artificial Sequence
  mRNA product Design3 comprising derived and/or modified sequence from Homo sapiens__NP_604390.1__HsRLN2 (opt10)
gggagagucccgcagucggcguccagcggcucugcuuguucgugugugugucguugcaggccuuauucaagcuuaccaugccgagguuauucuucuuucauuuauugggggugugccucuuguuaaaucaguucagucgcgccguggccgauagcuggauggaagaggucaucaagcucugugggagggagcucgucagggcccaaaucgcgaucugugggaugucgacguggucgaagcgcagcuuaucgcaagaggacgccccgcaaaccccgcgcccggucgccgagaucgucccgaguuuuauaaauaaggacaccgagacgaucaacaugaugagcgaguucgucgccaaccucccgcaagaauuaaaacucacguuaagcgaaaugcaaccggcccucccgcaauugcagcagcacgucccgguccucaaggacaguucguuguuguucgaggaguucaaaaaguugaucaggaaccgccagucggaggcggccgauucgucgccgagcgagcucaaguaucucgggcucgacacccacagcaggaagaaacgccaguuguauucggcccucgccaacaagugcugucacgucgggugcacgaagcgcagcuuggcccgcuucuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2058 - RNA, 776 nt, Artificial Sequence; identical to SEQ ID NO: 1371
  mRNA product Design3 comprising derived and/or modified sequence from Homo sapiens__NP_543140.1__HsRLN3  (opt10)

SEQ ID NO: 2059 - RNA, 1757 nt, Artificial Sequence
  mRNA product Design3 comprising derived and/or modified sequence from Homo sapiens__NP_002412.1__HsMMP1 (opt10)
gggagagucccgcagucggcguccagcggcucugcuuguucgugugugugucguugcaggccuuauucaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2060 - RNA, 3413 nt, Artificial Sequence; identical to SEQ ID NO: 1378
  mRNA product Design3 comprising derived and/or modified sequence from Clostridium histolyticum__BAA34542.1__ColH (opt10)

SEQ ID NO: 2061 - RNA, 2534 nt, Artificial Sequence
  mRNA product Design3 comprising derived and/or modified sequence from Homo sapiens__NP_000592.3__HsHGF (opt10)
gggagagucccgcagucggcguccagcggcucugcuuguucgugugugugucguugcaggccuuauucaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2062 - RNA, 965 nt, Artificial Sequence
  mRNA product Design3 comprising derived and/or modified sequence from Homo sapiens__NP_005253.3__HsGFER (opt10)
gggagagucccgcagucggcguccagcggcucugcuuguucgugugugugucguugcaggccuuauucaagcuuaccauggcagcaccaggcgaacgcggacgcuuccacggaggcaaccuauucuucuuacccggaggcgcacgcucagaaaugauggacgacuuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacauuagcggcguacuauccagaucuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaaugguuaugccacuuacacaacgaaguaaaccgcaaacucggaaaaccagacuucgacugcagcaaagucgacgaaagguggagagacggauggaaagacggaagcugcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 2063 - RNA, 1122 nt, Artificial Sequence
  mRNA product Design4 comprising derived and/or modified sequence from Homo sapiens__NP_003801.1__HsTNFSF10 (opt10)
gggagagucccgcagucggcguccagcggcucugcuuguucgugugugugucguugcaggccuuauucaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2064 - RNA, 843 nt, Artificial Sequence
  mRNA product Design4 comprising derived and/or modified sequence from Homo sapiens__NP_003801.1__HsTNFSF10(95-281) (opt10)
gggagagucccgcagucggcguccagcggcucugcuuguucgugugugugucguugcaggccuuauucaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2065 - RNA, 1353 nt, Artificial Sequence
  mRNA product Design4 comprising derived and/or modified sequence from Homo sapiens__NP_004355.2__HsCEBPA (opt10)
gggagagucccgcagucggcguccagcggcucugcuuguucgugugugugucguugcaggccuuauucaagcuuaccauggaaagcgcagacuucuacgaagcagaaccccgacccccuaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2066 - RNA, 1311 nt, Artificial Sequence
  mRNA product Design4 comprising derived and/or modified sequence from Homo sapiens__NP_004355.2__HsCEBPA(15-358) (opt10)
gggagagucccgcagucggcguccagcggcucugcuuguucgugugugugucguugcaggccuuauucaagcuuaccaugucaucucaccuacaaucgcccccacacgcccccuccuccgccgccuucggcuucccccgcggugccggccccgcucaaccgcccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggaccgccucccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagccuccccccccaccaccucccucacacccccacccacaucccccccccgcccaccucgccgcgccccaccuccaauuccaaaucgcacacugcggccaaacaacaaugcaccuacaacccggacaccccacaccucccccgacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2067 - RNA, 1701 nt, Artificial Sequence
  mRNA product Design4 comprising derived and/or modified sequence from Homo sapiens__NP_000448.3__HsHNF4A (opt10)
gggagagucccgcagucggcguccagcggcucugcuuguucgugugugugucguugcaggccuuauucaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgcuuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2068 - RNA, 906 nt, Artificial Sequence
  mRNA product Design4 comprising derived and/or modified sequence from Homo sapiens__NP_061986.1__HsFGF21 (opt10)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2069 - RNA, 1632 nt, Artificial Sequence
  mRNA product Design4 comprising derived and/or modified sequence from Homo sapiens__NP_078852.3__HsOGFRL1 (opt10)
gggagagucccgcagucggcguccagcggcucugcuuguucgugugugugucguugcaggccuuauucaagcuuaccauggggaauuuauuggggggcgugucguuuagggaaccgacgacggucgaagauugugauaguacguggcaaacggauagcgaaccggaaccggaggagccgggccccgggggggggucggaagggcccggccaagaaagugaacaaccggcccaaccgcccgaacaggcggggggcagaccgggggcgucgccggcccccgaugaagaugcggaagccgccggggcggaacaagggggggacaguaccgaggccaccgcgaagccgaaacgcucguucuacgccgcgcgcgaccucuauaaauauaggcaucaauauccgaauuuuaaggacauaagguaccagaacgaucucucgaacuugagguucuacaaaaacaagaucccguuuaaaccggacggggucuauaucgaggaggucuugucgaaguggaagggggacuacgagaaguuagaacauaaucauaccuauauccagugguuguuuccguuacgcgagcaggggcucaauuuuuacgcgaaggaguugaccaccuacgagaucgaagaguuuaagaagaccaaggaggccauccgccgcuuuuuguuagccuacaagaugauguuggaguucuucgggaucaaguuaaccgacaagaccgggaacgucgccagagccgucaauuggcaagagcgcuuccaacacuuaaacgaaagucaacauaauuaccuccgcauaaccaggaucuugaagucguugggggaauugggguacgagucguucaagagcccguuggucaaguucaucuugcacgaggccuuggucgaaaacaccaucccgaacaucaaacaaucggccuuggaauacuucgucuacaccauccgcgaucgccgcgagcgccgcaaauuguuaagauuugcgcaaaagcauuauaccccgagcgaaaauuucauaugggggcccccgaggaaggagcaaagcgaagggucgaaggcgcaaaagaugagcaguccguuggcgaguucgcacaauucgcagaccagcaugcauaagaaggcgaaagauaguaagaacaguaguagcgccguccaccucaacucgaagaccgccgaggauaagaaggucgccccgaaggaaccggucgaggaaaccgaucgcccgucgccggaaccgucgaacgaggccgcgaaaccgcgcaacaccgaaaaagauucgaacgccgaaaauaugaacagccagccggaaaagaccgucaccaccccgaccgagaagaaagaaucggucagcccggaaaacaaugaggagggggggaacgacaaucaggauaacgagaacccggggaacaccaacugucacgacgucgucuugguccaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2070 - RNA, 834 nt, Artificial Sequence
  mRNA product Design4 comprising derived and/or modified sequence from Homo sapiens__NP_008842.1__HsRLN1 (opt10)
gggagagucccgcagucggcguccagcggcucugcuuguucgugugugugucguugcaggccuuauucaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgcaccccaaacuccccgccccgucgccgagaucguccccuccuucaucaacaaagacaccgaaaccaucaucaucaugcucgaauuuaucgccaaccucccucccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugcuuaaucggcugcaccaaacgcucccucgccaaauacugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2071 - RNA, 834 nt, Artificial Sequence
  mRNA product Design4 comprising derived and/or modified sequence from Homo sapiens__NP_604390.1__HsRLN2 (opt10)
gggagagucccgcagucggcguccagcggcucugcuuguucgugugugugucguugcaggccuuauucaagcuuaccaugccgagguuauucuucuuucauuuauugggggugugccucuuguuaaaucaguucagucgcgccguggccgauagcuggauggaagaggucaucaagcucugugggagggagcucgucagggcccaaaucgcgaucugugggaugucgacguggucgaagcgcagcuuaucgcaagaggacgccccgcaaaccccgcgcccggucgccgagaucgucccgaguuuuauaaauaaggacaccgagacgaucaacaugaugagcgaguucgucgccaaccucccgcaagaauuaaaacucacguuaagcgaaaugcaaccggcccucccgcaauugcagcagcacgucccgguccucaaggacaguucguuguuguucgaggaguucaaaaaguugaucaggaaccgccagucggaggcggccgauucgucgccgagcgagcucaaguaucucgggcucgacacccacagcaggaagaaacgccaguuguauucggcccucgccaacaagugcugucacgucgggugcacgaagcgcagcuuggcccgcuucuguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2072 - RNA, 705 nt, Artificial Sequence
  mRNA product Design4 comprising derived and/or modified sequence from Homo sapiens__NP_543140.1__HsRLN3  (opt10)
gggagagucccgcagucggcguccagcggcucugcuuguucgugugugugucguugcaggccuuauucaagcuuaccauggcgcgcuauauguugcuauugcucuuggccgugugggugcucacgggcgagcucuggcccggggccgaggccagggccgcgcccuauggcgugcgcuugugcgggcgcgaguucauacgagcggucauauucacgugcgggggcucgcgcuggcgcaggagcgauauauuggcccaugaagcgaugggggacacguucccggacgcggacgcggacgaggacucgcucgcgggcgagcucgaugaagcgauggggagcucggaauggcuagcgcuaacgaaaucgccccaggccuuuuacaggggcaggcccucguggcagggaacgcccgggguauugcgagggagcagggacgugcucgcgggcuugagcucaagcuguugcaagugggggugcucgaaaucggaaauaagcucgcucuguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2073 - RNA, 1686 nt, Artificial Sequence
  mRNA product Design4 comprising derived and/or modified sequence from Homo sapiens__NP_002412.1__HsMMP1 (opt10)
gggagagucccgcagucggcguccagcggcucugcuuguucgugugugugucguugcaggccuuauucaagcuuaccaugcauucguucccgccguuauuauuauuauuauuuuggggggucgucagccauucguuuccggccaccuuggagacccaggaacaggacgucgaucucgugcaaaaguauuuagagaaguauuauaauuuaaaaaacgacggccgccaggucgagaaaagacgcaacucggggccggucgucgagaagcucaaacagaugcaagaguuuuucggcuuaaaggucaccggcaagccggacgccgagacguuaaaagucaugaaacaaccgcgcugcggggucccggacgucgcccaauucguguugaccgaaggcaauccgaggugggaacagacccacuuaacguaucgcaucgagaacuauaccccggaccucccgcgcgccgacgucgaucacgcgaucgaaaaggcguuucaguuguggucgaacgugaccccguuaaccuuuacgaaagugagcgaagggcaggccgauauaaugaucagcuucgugcgcggggaccacagagauaauagcccguucgacgggccgggggggaacuuggcccacgccuuccagccggggccggggaucgggggcgacgcccacuucgacgaggacgagcgcuggacgaauaacuuucgcgaauauaaucuccacagggucgccgcccacgaguuggggcacagcuugggguugagucacagcaccgacauaggcgcccucauguauccgucguauacguuuucgggggacguccaauuggcccaagacgauaucgacgggauacaggcgaucuacgggaggagucagaacccggugcaaccgauagggccgcagacgccgaaggccugcgauucgaaauugacguucgacgccaucaccaccaucagaggggaggucauguuuuucaaggaucgcuuuuauaugaggaccaacccguuuuaucccgaggucgaauugaacuuuaucagcgucuuuuggccgcaguuaccgaacggcuuggaggccgccuaugaguucgcggaucgcgacgaggugagauucuuuaagggcaacaaauauugggccguccaagggcaaaacgucuugcauggguauccgaaagauauauauucgaguuucggguuuccgcgcaccgucaaacacauagacgccgccuugagcgaagagaauaccgggaagacguauuuuuucgucgccaauaaguauuggcgcuacgacgaguacaagaggagcauggacccgggguacccgaagaugaucgcccacgauuucccggggaucgggcauaaggucgacgccgucuuuaugaaggacggguucuuuuacuuuuuccacgggacccgccaguauaaguucgacccgaagaccaaacgcauccucaccuugcaaaaggccaacucgugguuuaauugucgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2074 - RNA, 3342 nt, Artificial Sequence
  mRNA product Design4 comprising derived and/or modified sequence from Clostridium histolyticum__BAA34542.1__ColH (opt10)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2075 - RNA, 2463 nt, Artificial Sequence
  mRNA product Design4 comprising derived and/or modified sequence from Homo sapiens__NP_000592.3__HsHGF (opt10)
gggagagucccgcagucggcguccagcggcucugcuuguucgugugugugucguugcaggccuuauucaagcuuaccaugugggucacgaaguuguuaccggcguuauuauuacaacacguguuguuacacuuguuguuauugccgauagcgauaccguaugccgaagggcagcgcaagcgccgcaauaccauccacgaguuuaagaagagugccaaaaccacguugauaaagaucgacccggccuuaaaaaucaagacgaaaaaggucaacaccgccgaucagugcgccaaccgcugcacccgcaacaagggguugccguuuaccuguaaagccuucgucuucgacaaggcccgcaagcaauguuugugguuuccguuuaacucgaugagcucgggggucaagaaggaguucgggcacgaguucgauuuguaugagaauaaggauuauauccgcaauuguauaaucgggaaagggaggucguauaaagggaccgucagcauaaccaaaucggggauaaaaugccaaccguggucgaguaugaucccgcaugagcauucguuccucccgagcucguacagagggaaggauuugcaagagaauuauugcaggaacccgaggggcgaggagggcgggccguggugcuuuaccucgaacccggaagucagguaugaggugugcgauaucccgcaaugcagcgaggucgaguguaugacguguaacggcgaaucguacaggggguugauggaccacaccgagagcgggaaaaucugccaaaggugggaccaccaaaccccgcauagacauaaauuucucccggagcgcuauccggauaaaggguucgacgacaacuacuguaggaacccggacgggcaaccccgcccgugguguuauaccuuggauccgcauacgaggugggaauauugcgccaucaaaaccugugccgauaacaccaugaacgauaccgacgucccgcucgagaccaccgaguguauacaggggcagggggagggguaucgcgggaccgugaacacgaucuggaacgggaucccgugccaaaggugggacagccaauauccgcaugaacacgauaugaccccggagaacuuuaaauguaaagauuugagggagaacuauuguaggaacccggacggcagcgagagcccguggugcuucacgaccgacccgaauauaagggucggguauuguagucagaucccgaauugcgacaugagccacgggcaagacugcuauaggggcaacgggaaaaacuacauggggaaucucagucagacccgcagcggguugaccugcagcaugugggauaaaaauauggaggaucuccacaggcacauauuuugggagccggacgccucgaaauuaaacgaaaacuauuguaggaacccggacgacgacgcccacgggccgugguguuauaccgggaacccguugaucccgugggacuauuguccgaucaguaggugcgagggggacacgaccccgaccaucgugaaccucgaucacccggucaucagcugcgcgaagaccaagcagcucagggucgucaacggcaucccgaccaggaccaauaucggguggauggucucgcuccgcuaucgcaacaagcacauauguggggggagccucaucaaagaaucgugggucuugaccgccaggcaaugcuuuccgagcagggaucucaaggacuacgaggccugguuggggauccacgacgugcaugggcgcggggacgaaaaguguaagcaagucuugaacgucagucaauuagucuacgggccggaggggagcgacuuaguccucaugaaauuggcgcgcccggccguguuagacgacuucgucucgaccaucgaccucccgaauuacggguguaccaucccggagaaaacgucguguucggucuauggguggggguauaccgggcucauaaauuacgacggguugcucagggucgcccacuuguauaucauggggaacgaaaaguguucgcaacaccacaggggcaaagucaccuuaaacgaaagcgagaucugcgccggcgccgagaaaaucgggagcgggccgugcgaaggcgacuauggggggccguuggucugcgaacagcacaaaaugcgcauggucuugggggugaucgucccggggagggggugcgcgaucccgaacaggccggggaucuucgugagggucgccuacuacgccaaguggauccauaagaucauccucaccuauaaagucccgcaaagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2076 - RNA, 894 nt, Artificial Sequence
  mRNA product Design4 comprising derived and/or modified sequence from Homo sapiens__NP_005253.3__HsGFER (opt10)
gggagagucccgcagucggcguccagcggcucugcuuguucgugugugugucguugcaggccuuauucaagcuuaccauggcagcaccaggcgaacgcggacgcuuccacggaggcaaccuauucuucuuacccggaggcgcacgcucagaaaugauggacgacuuagccacagacgcgcgaggacgcggagccggacgaagagacgcagccgcaagcgcaagcacacccgcacaagcacccacgagcgacagcccagucgcggaagacgccucacgcaggcgcccaugcagagccugcgucgacuucaagaccuggaugagaacacaacaaaaacgcgacaccaaauucagagaagacugcccacccgaccgagaagaacuaggcaggcacucgugggcaguccugcacacauuagcggcguacuauccagaucuacccacacccgaacaacaacaagacauggcgcaauucauccaccucuucagcaaauucuaccccugcgaagaaugcgcggaagaccucagaaaaagacucugccgaaaccacccggacacacgcacacgagcaugcuucacccaaugguuaugccacuuacacaacgaaguaaaccgcaaacucggaaaaccagacuucgacugcagcaaagucgacgaaagguggagagacggauggaaagacggaagcugcgacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2077 - RNA, 1122 nt, Artificial Sequence
  mRNA product Design4 comprising derived and/or modified sequence from Homo sapiens__NP_003801.1__HsTNFSF10  (wt)
gggagagucccgcagucggcguccagcggcucugcuuguucgugugugugucguugcaggccuuauucaagcuuaccauggcuaugauggagguccaggggggacccagccugggacagaccugcgugcugaucgugaucuucacagugcuccugcagucucucuguguggcuguaacuuacguguacuuuaccaacgagcugaagcagaugcaggacaaguacuccaaaaguggcauugcuuguuucuuaaaagaagaugacaguuauugggaccccaaugacgaagagaguaugaacagccccugcuggcaagucaaguggcaacuccgucagcucguuagaaagaugauuuugagaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2078 - RNA, 843 nt, Artificial Sequence
  mRNA product Design4 comprising derived and/or modified sequence from Homo sapiens__NP_003801.1__HsTNFSF10(95-281) (wt)
gggagagucccgcagucggcguccagcggcucugcuuguucgugugugugucguugcaggccuuauucaagcuuaccaugaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2079 - RNA, 894 nt, Artificial Sequence
  mRNA product Design4 comprising derived and/or modified sequence from Homo sapiens__NP_003801.1__HsALB(1-18)_HsTNFSF10(95-281) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2080 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccagaaugaagcagaucgaggacaaaauugaagagauccugagcaagauuuaccacaucgaaaacgagauugccaggaucaaaaagcucauuggcgaaaccucugaggaaaccauuucuacaguucaagaaaagcaacaaaauauuucuccccuagugagagaaagagguccucagagaguagcagcucacauaacugggaccagaggaagaagcaacacauugucuucuccaaacuccaagaaugaaaaggcucugggccgcaaaauaaacuccugggaaucaucaaggagugggcauucauuccugagcaacuugcacuugaggaauggugaacuggucauccaugaaaaaggguuuuacuacaucuauucccaaacauacuuucgauuucaggaggaaauaaaagaaaacacaaagaacgacaaacaaaugguccaauauauuuacaaauacacaaguuauccugacccuauauuguugaugaaaagugcuagaaauaguuguuggucuaaagaugcagaauauggacucuauuccaucuaucaagggggaauauuugagcuuaaggaaaaugacagaauuuuuguuucuguaacaaaugagcacuugauagacauggaccaugaagccaguuuuuuuggggccuuuuuaguuggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2081 - RNA, 1353 nt, Artificial Sequence
  mRNA product Design4 comprising derived and/or modified sequence from Rattus norvegicus__NP_036656.1__RnCebpa (wt)
gggagagucccgcagucggcguccagcggcucugcuuguucgugugugugucguugcaggccuuauucaagcuuaccauggagucggccgacuucuacgaggcggagccgcggcccccgaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2082 - RNA, 1311 nt, Artificial Sequence
  mRNA product Design4 comprising derived and/or modified sequence from Rattus norvegicus__NP_036656.1__RnCebpa(15-344) (wt)
gggagagucccgcagucggcguccagcggcucugcuuguucgugugugugucguugcaggccuuauucaagcuuaccaugagcagccaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccggcagcaggagaaggccaaggcggcggcgggccccgcggguggcggcggugacuuugacuacccgggcgccccggcgggccccggcggugcggucauguccgcgggggcgcacggacccccucccggcuacggcugugcggcggccggcuaccuggacggcaggcuggagccccuguacgagcgcgucggggcgcccgcgcugcggccgcuggugaucaagcaggagccccgcgaggaggacgaggcgaagcagcuggcgcuggccggccucuuccccuaucagcccccgccgccgccgccgccaccgcacccgcacgcgucucccgcgcacuuggccgccccucacuugcaguuccagaucgcacacugcggccagaccaccaugcaccugcagccuggccacccuacgccgccgccgacgcccgugcccagcccucaucccgcgccugcaaugggugcugcgggccugccgggccccgggggcucgcucaagggcuuggcugguccgcaccccgaccuccgcaccggcggcggcggcggcggcggggccggcgcgggcaaggccaagaagucgguggauaagaacagcaacgaguaccggguacggcgggaacgcaacaacaucgcggugcgcaagagccgagauaaagccaaacagcgcaacguggagacgcagcagaagguguuggaguugaccagugacaaugaccgccugcgcaagcggguggaacagcugagccgugaacuggacacgcugcgggguaucuuccgccagcugccugagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2083 - RNA, 1356 nt, Artificial Sequence
  mRNA product Design4 comprising derived and/or modified sequence from Mus musculus__NP_031704.2 __MmCebpa (wt)
gggagagucccgcagucggcguccagcggcucugcuuguucgugugugugucguugcaggccuuauucaagcuuaccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2084 - RNA, 1314 nt, Artificial Sequence
  mRNA product Design4 comprising derived and/or modified sequence from Mus musculus__NP_031704.2 __MmCebpa(15-359) (wt)
gggagagucccgcagucggcguccagcggcucugcuuguucgugugugugucguugcaggccuuauucaagcuuaccaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2085 - RNA, 1353 nt, Artificial Sequence
  mRNA product Design4 comprising derived and/or modified sequence from Homo sapiens__NP_004355.2__HsCEBPA (wt)
gggagagucccgcagucggcguccagcggcucugcuuguucgugugugugucguugcaggccuuauucaagcuuaccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2086 - RNA, 1311 nt, Artificial Sequence
  mRNA product Design4 comprising derived and/or modified sequence from Homo sapiens__NP_004355.2__HsCEBPA (wt)
gggagagucccgcagucggcguccagcggcucugcuuguucgugugugugucguugcaggccuuauucaagcuuaccaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2087 - RNA, 1353 nt, Artificial Sequence
  mRNA product Design4 comprising derived and/or modified sequence from Homo sapiens__NP_004355.2__HsCEBPA(15-358) (wt)
gggagagucccgcagucggcguccagcggcucugcuuguucgugugugugucguugcaggccuuauucaagcuuaccauggagucggccgacuucuacgaggcggagccgcggcccccgaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2088 - RNA, 1311 nt, Artificial Sequence
  mRNA product Design4 comprising derived and/or modified sequence from Homo sapiens__NP_004355.2__HsCEBPA(15-358) (wt)
gggagagucccgcagucggcguccagcggcucugcuuguucgugugugugucguugcaggccuuauucaagcuuaccaugagcagccaccuccagagccccccgcacgcgcccagcagcgccgccuucggcuuuccccggggcgcgggccccgcgcagccucccgccccuccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccuccaguuccagaucgcgcacugcggccagaccaccaugcaccuccagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2089 - RNA, 1701 nt, Artificial Sequence
  mRNA product Design4 comprising derived and/or modified sequence from Homo sapiens__NP_000448.3__HsHNF4A (wt)
gggagagucccgcagucggcguccagcggcucugcuuguucgugugugugucguugcaggccuuauucaagcuuaccaugcgacucuccaaaacccucgucgacauggacauggccgacuacagugcugcacuggacccagccuacaccacccuggaauuugagaaugugcagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccugcugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccaggugcaggugagcuuggaggacuacaucaacgaccgccaguaugacucgcguggccgcuuuggagagcugcugcugcugcugcccaccuugcagagcaucaccuggcagaugaucgagcagauccaguucaucaagcucuucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2090 - RNA, 1701 nt, Artificial Sequence
  mRNA product Design4 comprising derived and/or modified sequence from Homo sapiens__NP_000448.3__HsHNF4A (wt)
gggagagucccgcagucggcguccagcggcucugcuuguucgugugugugucguugcaggccuuauucaagcuuaccaugcgacucuccaaaacccucgucgacauggacauggccgacuacagugcugcacuggacccagccuacaccacccuggaauuugagaauguccagguguugacgaugggcaaugacacguccccaucagaaggcaccaaccucaacgcgcccaacagccugggugucagcgcccugugugccaucugcggggaccgggccacgggcaaacacuacggugccucgagcugugacggcugcaagggcuucuuccggaggagcgugcggaagaaccacauguacuccugcagauuuagccggcagugcgugguggacaaagacaagaggaaccagugccgcuacugcaggcucaagaaaugcuuccgggcuggcaugaagaaggaagccguccagaaugagcgggaccggaucagcacucgaaggucaagcuaugaggacagcagccugcccuccaucaaugcgcuccugcaggcggagguccugucccgacagaucaccucccccgucuccgggaucaacggcgacauucgggcgaagaagauugccagcaucgcagaugugugugaguccaugaaggagcagcugcugguucucguugagugggccaaguacaucccagcuuucugcgagcucccccuggacgaccagguggcccugcucagagcccaugcuggcgagcaccuccugcucggagccaccaagagauccaugguguucaaggacgugcugcuccuaggcaaugacuacauugucccucggcacugcccggagcuggcggagaugagccggguguccauacgcauccuugacgagcuggugcugcccuuccaggagcugcagaucgaugacaaugaguaugccuaccucaaagccaucaucuucuuugacccagaugccaaggggcugagcgauccagggaagaucaagcggcugcguucccagguccaggugagcuuggaggacuacaucaacgaccgccaguaugacucgcguggccgcuuuggagagcugcugcugcugcugcccaccuugcagagcaucaccuggcagaugaucgagcagauccaguucaucaagcuguucggcauggccaagauugacaaccuguugcaggagaugcugcugggagggucccccagcgaugcaccccaugcccaccacccccugcacccucaccugaugcaggaacauaugggaaccaacgucaucguugccaacacaaugcccacucaccucagcaacggacagaugugugaguggccccgacccaggggacaggcagccaccccugagaccccacagcccucaccgccagguggcucagggucugagcccuauaagcuccugccgggagccgucgccacaaucgucaagccccucucugccaucccccagccgaccaucaccaagcaggaaguuaucuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2091 - RNA, 906 nt, Artificial Sequence
  mRNA product Design4 comprising derived and/or modified sequence from Homo sapiens__NP_061986.1__HsFGF21 (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2092 - RNA, 906 nt, Artificial Sequence
  mRNA product Design4 comprising derived and/or modified sequence from Homo sapiens__NP_061986.1__HsFGF21 (wt) R5987
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2093 - RNA, 1632 nt, Artificial Sequence
  mRNA product Design4 comprising derived and/or modified sequence from Homo sapiens__NP_078852.3__HsOGFRL1 (wt)
gggagagucccgcagucggcguccagcggcucugcuuguucgugugugugucguugcaggccuuauucaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaauucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaauucucaaccugagaaaacaguuacuacucccacagaaaaaaaggagaguguaucuccugagaauaacgaagaagguggaaaugauaaccaagacaaugaaaauccuggaaauacaaauugccaugauguuguacuaguacagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2094 - RNA, 1632 nt, Artificial Sequence
  mRNA product Design4 comprising derived and/or modified sequence from Homo sapiens__NP_078852.3__HsOGFRL1 (wt)
gggagagucccgcagucggcguccagcggcucugcuuguucgugugugugucguugcaggccuuauucaagcuuaccaugggcaaccugcucggcggggucagcuuccgcgagcccaccaccguggaggacugcgacuccaccuggcagaccgacucggagcccgagcccgaagaaccagggccgggcggcggcagcgagggcccggggcaggaguccgagcagcccgcgcagcccccggagcaagccggcgggcggcccggcgccagccccgcgccggacgaggacgccgaggcggcgggcgccgagcaggguggugauuccacugaagcaacugccaaaccaaagagaaguuuuuaugcugccagggauuuguacaaguaccgacaccaguacccaaacuucaaagauauccgauaucaaaaugacuugagcaaucuucguuuuuauaagaauaaaauuccauucaagccagaugguguuuacauugaagaaguucuaaguaaauggaaaggagauuaugaaaaacuggagcacaaccacacuuacauucaauggcuuuucccccugagagaacaaggcuugaacuucuaugccaaagaacuaacuacauaugaaauugaggaguucaaaaaaacaaaagaagcaauuagaagauuccuccuggcuuauaaaaugaugcuagaauuuuuuggaauaaaacugacugauaaaacuggaaauguugcucgggcuguuaacuggcaggaaagauuucagcaucugaaugagucccagcacaacuauuuaagaaucacucguauucuuaaaagccuuggugagcuuggauaugaaaguuuuaaaucuccucuuguaaaauuuauucuucaugaagcucuuguggagaauacuauucccaauauuaagcagagugcucuagaguauuuuguuuauacaauuagagacagaagagaaaggagaaagcuccugcgguucgcccagaaacacuacacgccuucagagaacuuuaucuggggaccgccucgaaaagaacagucggagggaagcaaagcccagaaaaugucuuccccucucgccuccagucauaacagucaaacuucuaugcacaaaaaagccaaggacuccaaaaauuccuccucagcuguucauuuaaauagcaaaacagcugaagacaaaaaaguggcaccaaaagagccuguggaagagacagacaggcccagcccagagcccagcaaugaagcugccaagccaagaaauacagagaaggacaguaaugcugagaacaugaacucucaaccugagaaaacaguuacuacucccacagaaaaaaaggagaguguaucuccugagaauaacgaagaagguggaaaugauaaccaagacaaugaaaauccuggaaauacaaauugccaugauguuguacuuguacagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2095 - RNA, 834 nt, Artificial Sequence
  mRNA product Design4 comprising derived and/or modified sequence from Homo sapiens__NP_008842.1__HsRLN1 (wt)
gggagagucccgcagucggcguccagcggcucugcuuguucgugugugugucguugcaggccuuauucaagcuuaccaugccucgccuguucuuguuccaccugcuagaauucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaauucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2096 - RNA, 834 nt, Artificial Sequence
  mRNA product Design4 comprising derived and/or modified sequence from Homo sapiens__NP_008842.1__HsRLN1 (wt)
gggagagucccgcagucggcguccagcggcucugcuuguucgugugugugucguugcaggccuuauucaagcuuaccaugccucgccuguucuuguuccaccuccuagaguucuguuuacuacugaaccaauuuuccagagcagucgcggccaaauggaaggacgauguuauuaaauuaugcggccgcgaauuaguucgcgcgcagauugccauuugcggcaugagcaccuggagcaaaaggucucugagccaggaagaugcuccucagacaccuagaccaguggcagaaauuguaccauccuucaucaacaaagauacagaaacuauaauuaucauguuggaguucauugcuaauuugccaccggagcugaaggcagcccuaucugagaggcaaccaucauuaccagagcuacagcaguauguaccugcauuaaaggauuccaaucuuagcuuugaagaauuuaagaaacuuauucgcaauaggcaaagugaagccgcagacagcaauccuucagaauuaaaauacuuaggcuuggauacucauucucaaaaaaagagacgacccuacguggcacuguuugagaaauguugccuaauugguuguaccaaaaggucucuugcuaaauauugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2097 - RNA, 834 nt, Artificial Sequence
  mRNA product Design4 comprising derived and/or modified sequence from Homo sapiens__NP_604390.1__HsRLN2 (wt)
gggagagucccgcagucggcguccagcggcucugcuuguucgugugugugucguugcaggccuuauucaagcuuaccaugccucgccuguuuuuuuuccaccugcuaggagucuguuuacuacugaaccaauuuuccagagcagucgcggacucauggauggaggaaguuauuaaauuaugcggccgcgaauuaguucgcgcgcagauugccauuugcggcaugagcaccuggagcaaaaggucucugagccaggaagaugcuccucagacaccuagaccaguggcagaaauugugccauccuucaucaacaaagauacagaaaccauaaauaugaugucagaauuuguugcuaauuugccacaggagcugaaguuaacccugucugagaugcagccagcauuaccacagcuacaacaacauguaccuguauuaaaagauuccagucuucucuuugaagaauuuaagaaacuuauucgcaauagacaaagugaagccgcagacagcaguccuucagaauuaaaauacuuaggcuuggauacucauucucgaaaaaagagacaacucuacagugcauuggcuaauaaauguugccauguugguuguaccaaaagaucucuugcuagauuuugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2098 - RNA, 705 nt, Artificial Sequence
  mRNA product Design4 comprising derived and/or modified sequence from Homo sapiens__NP_543140.1__HsRLN3  (wt)
gggagagucccgcagucggcguccagcggcucugcuuguucgugugugugucguugcaggccuuauucaagcuuaccauggccagguacaugcugcugcugcuccuggcgguaugggugcugaccggggagcuguggccgggagcugaggcccgggcagcgccuuacggggucaggcuuugcggccgagaauucauccgagcagucaucuucaccugcgggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2099 - RNA, 705 nt, Artificial Sequence
  mRNA product Design4 comprising derived and/or modified sequence from Homo sapiens__NP_543140.1__HsRLN3  (wt)
gggagagucccgcagucggcguccagcggcucugcuuguucgugugugugucguugcaggccuuauucaagcuuaccauggccagguacaugcugcugcugcuccuggcgguaugggugcugaccggggagcuguggccgggagcugaggcccgggcagcgccuuacggggucaggcuuugcggccgagaguucauccgagcagucaucuucaccugugggggcucccgguggagacgaucagacauccuggcccacgaggcuaugggagauaccuucccggaugcagaugcugaugaagacagucuggcaggcgagcuggaugaggccaugggguccagcgaguggcuggcccugaccaagucaccccaggccuuuuacagggggcgacccagcuggcaaggaaccccugggguucuucggggcagccgagauguccuggcuggccuuuccagcagcugcugcaaguggggguguagcaaaagugaaaucaguagccuuugcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2100 - RNA, 1686 nt, Artificial Sequence
  mRNA product Design4 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2101 - RNA, 1686 nt, Artificial Sequence
  mRNA product Design4 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2102 - RNA, 1446 nt, Artificial Sequence
  mRNA product Design4 comprising derived and/or modified sequence from Homo sapiens__NP_002412.1__HsMMP1(1-19,100-469) (wt)
gggagagucccgcagucggcguccagcggcucugcuuguucgugugugugucguugcaggccuuauucaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2103 - RNA, 3633 nt, Artificial Sequence
  mRNA product Design4 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2104 - RNA, 3633 nt, Artificial Sequence
  mRNA product Design4 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2105 - RNA, 3357 nt, Artificial Sequence
  mRNA product Design4 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2106 - RNA, 3357 nt, Artificial Sequence
  mRNA product Design4 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2107 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2108 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2109 - RNA, 3381 nt, Artificial Sequence
  mRNA product Design4 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2110 - RNA, 3381 nt, Artificial Sequence
  mRNA product Design4 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2111 - RNA, 3342 nt, Artificial Sequence
  mRNA product Design4 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2112 - RNA, 3342 nt, Artificial Sequence
  mRNA product Design4 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2113 - RNA, 3276 nt, Artificial Sequence
  mRNA product Design4 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2114 - RNA, 3276 nt, Artificial Sequence
  mRNA product Design4 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2115 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2116 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2117 - RNA, 1122 nt, Artificial Sequence
  mRNA product Design4 comprising derived and/or modified sequence from Homo sapiens__NP_003801.1__HsTNFSF10 (opt1)
gggagagucccgcagucggcguccagcggcucugcuuguucgugugugugucguugcaggccuuauucaagcuuaccauggccaugauggaggugcagggcgggcccagccugggccagaccugcguccucaucgugaucuucaccgugcugcugcagucccucugcgucgccgugacguacguguacuucaccaacgagcugaagcagaugcaggacaaguacagcaaguccgggaucgcgugcuuccugaaggaggacgacagcuacugggacccgaacgacgaggaguccaugaacagcccgugcuggcaggucaaguggcagcuccgccagcuggugcggaagaugauccugcgcaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2118 - RNA, 843 nt, Artificial Sequence
  mRNA product Design4 comprising derived and/or modified sequence from Homo sapiens__NP_003801.1__HsTNFSF10(95-281) (opt1)
gggagagucccgcagucggcguccagcggcucugcuuguucgugugugugucguugcaggccuuauucaagcuuaccaugaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2119 - RNA, 894 nt, Artificial Sequence
  mRNA product Design4 comprising derived and/or modified sequence from Homo sapiens__NP_003801.1__HsALB(1-18)_HsTNFSF10(95-281) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2120 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt1) R6154/R6226
gggagagucccgcagucggcguccagcggcucugcuuguucgugugugugucguugcaggccuuauucaagcuuaccaugaagugggugaccuucaucagccugcucuuccuguucuccagcgccuacucccgcaugaagcagaucgaggacaagaucgaggagauccugagcaagaucuaccacaucgagaacgagaucgcccggaucaagaagcucaucggcgagaccuccgaggagaccaucagcacggugcaggagaagcagcagaacaucuccccgcucguccgggagcgcggcccccagcggguggccgcccacaucaccgggacccgcggccggagcaacacccuguccagcccgaacuccaagaacgagaaggcccugggccgcaagaucaacagcugggaguccagccgguccgggcacagcuuccucuccaaccugcaccuccgcaacggcgagcucgugauccacgagaagggguucuacuacaucuacagccagacguacuuccgguuccaggaggagaucaaggagaacaccaagaacgacaagcagaugguccaguacaucuacaaguacaccagcuaccccgaccccauccugcugaugaaguccgcccgcaacagcugcugguccaaggacgcggaguacggccucuacagcaucuaccagggcgggaucuucgagcugaaggagaacgaccggaucuucguguccgugaccaacgagcaccugaucgacauggaccacgaggccagcuucuucggcgccuuccucgucgggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2121 - RNA, 1353 nt, Artificial Sequence
  mRNA product Design4 comprising derived and/or modified sequence from Rattus norvegicus__NP_036656.1__RnCebpa (opt1)
gggagagucccgcagucggcguccagcggcucugcuuguucgugugugugucguugcaggccuuauucaagcuuaccauggagagcgccgacuucuacgaggccgagccccgcccgcccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2122 - RNA, 1311 nt, Artificial Sequence
  mRNA product Design4 comprising derived and/or modified sequence from Rattus norvegicus__NP_036656.1__RnCebpa(15-344) (opt1)
gggagagucccgcagucggcguccagcggcucugcuuguucgugugugugucguugcaggccuuauucaagcuuaccauguccagccaccuccaguccccgccccacgcgcccagcaacgccgccuucggcuucccccgcggggccggccccgcgcccccgcccgccccgcccgccgcccccgagccccucgggggcaucugcgagcacgagaccuccaucgacaucagcgccuacaucgaccccgcggccuucaacgacgaguuccuggccgaccuguuccagcacucccggcagcaggagaaggccaaggccgcggccgggcccgccggcggcgggggcgacuucgacuacccgggggcccccgccggccccgggggcgcggugaugagcgccggcgcccacgggcccccgcccggcuacgggugcgccgccgcgggcuaccuggacggccggcuggagccccuguacgagcgcgucggggcccccgcccuccggccgcuggugaucaagcaggagccccgcgaggaggacgaggccaagcagcuggcccucgcgggccuguuccccuaccagcccccgcccccgcccccgccgccccacccccacgccucccccgcccaccuggccgcgccccaccuccaguuccagaucgcccacugcgggcagaccacgaugcaccuccagcccggccaccccaccccgccgcccacccccgugcccagcccccaccccgcccccgccaugggggccgcgggccugcccggccccgggggcucccugaaggggcuggccggcccccacccggaccugcggaccgggggcggcgggggcgggggcgccggggccggcaaggccaagaaguccgucgacaagaacagcaacgaguaccgcgugcggcgcgagcggaacaacaucgcggugcgcaagagccgggacaaggccaagcagcgcaacgucgagacgcagcagaaggugcucgagcugaccuccgacaacgaccggcugcgcaagcggguggagcagcucagccgcgagcuggacacccugcggggcaucuuccgccagcuccccgaguccagccuggucaaggccauggggaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2123 - RNA, 1356 nt, Artificial Sequence
  mRNA product Design4 comprising derived and/or modified sequence from Mus musculus__NP_031704.2 __MmCebpa (opt1)
gggagagucccgcagucggcguccagcggcucugcuuguucgugugugugucguugcaggccuuauucaagcuuaccauggagagcgccgacuucuacgagguggagccccgcccgcccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2124 - RNA, 1314 nt, Artificial Sequence
  mRNA product Design4 comprising derived and/or modified sequence from Mus musculus__NP_031704.2 __MmCebpa(15-359) (opt1)
gggagagucccgcagucggcguccagcggcucugcuuguucgugugugugucguugcaggccuuauucaagcuuaccauguccagccaccuccaguccccgccccacgcccccagcaacgcggccuucggcuucccccgcggggccggccccgcgcccccgcccgccccgcccgccgcccccgagccccucgggggcaucugcgagcacgagaccuccaucgacaucagcgccuacaucgaccccgccgcguucaacgacgaguuccuggccgaccuguuccagcacucccggcagcaggagaaggccaaggccgccgcggggcccgccggcggcgggggcgacuucgacuacccgggggcccccgccggccccgggggcgccgucaugagcgcgggcgcccacgggcccccgcccggcuacgggugcgccgccgccggcuaccuggacggccggcuggagccccuguacgagcgcgugggggcgcccgcccuccggccgcuggugaucaagcaggagccccgcgaggaggacgaggccaagcagcuggcccucgccggccuguuccccuaccagcccccgccgccgcccccgccgccccacccccacgcgucccccgcccaccuggccgcgccccaccuccaguuccagaucgcccacugcgggcagaccacgaugcaccuccagcccggccaccccacgcccccgcccacccccguccccagcccccacgccgcccccgcccugggggccgcgggccugcccggccccggguccgcccugaagggccuggccggggcccaccccgaccuccggaccggcgggggcggcgggggcagcggggccggcgcggggaaggccaagaaguccguggacaagaacagcaacgaguaccgcgugcggcgcgagcggaacaacaucgccguccgcaagucccgggacaaggccaagcagcgcaacguggagacccagcagaaggugcuggagcugaccagcgacaacgaccggcuccgcaagcgggucgagcagcugucccgcgagcuggacacccuccggggcaucuuccgccagcugcccgagagcucccuggugaaggccaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2125 - RNA, 1353 nt, Artificial Sequence
  mRNA product Design4 comprising derived and/or modified sequence from Homo sapiens__NP_004355.2__HsCEBPA (opt1)
gggagagucccgcagucggcguccagcggcucugcuuguucgugugugugucguugcaggccuuauucaagcuuaccauggagagcgccgacuucuacgaggccgagccccgcccgcccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2126 - RNA, 1311 nt, Artificial Sequence
  mRNA product Design4 comprising derived and/or modified sequence from Homo sapiens__NP_004355.2__HsCEBPA(15-358) (opt1)
gggagagucccgcagucggcguccagcggcucugcuuguucgugugugugucguugcaggccuuauucaagcuuaccauguccagccaccuccaguccccgccccacgcgcccagcuccgccgccuucggcuucccccgcggggccggccccgcccagcccccggcgccgcccgccgcccccgagccccucgggggcaucugcgagcacgagaccagcaucgacaucuccgccuacaucgaccccgcggccuucaacgacgaguuccuggccgaccuguuccagcacagccggcagcaggagaaggccaaggccgcgguggggcccaccggcggcgggggcgggggcgacuucgacuaccccggggccccggccggccccggcggggccgucaugcccggcggggcccacgggcccccgcccggcuacggcugcgcggccgccggcuaccuggacgggcggcuggagccccuguacgagcgcgugggcgcccccgcccuccggccgcuggugaucaagcaggagccccgcgaggaggacgaggcgaagcagcuggcccucgccgggcuguuccccuaccagcccccgcccccgcccccgcccucccacccccacccccacccgccgcccgcccaccuggccgcgccccaccuccaguuccagaucgcccacugcggccagacgaccaugcaccuccagcccggccaccccacgcccccgcccacccccguccccagcccccaccccgcccccgcccugggggcggccggccugcccgggccgggcuccgcccugaaggggcugggcgccgcccaccccgaccuccgggcgagcggcggguccggcgccgggaaggccaagaaguccguggacaagaacagcaacgaguaccgcgugcggcgcgagcggaacaacaucgccguccgcaagagccgggacaaggccaagcagcgcaacguggagacccagcagaaggugcuggagcugaccuccgacaacgaccggcuccgcaagcgggucgagcagcugagccgcgagcuggacacccuccggggcaucuuccgccagcugcccgaguccagccuggugaaggcgauggggaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2127 - RNA, 1701 nt, Artificial Sequence
  mRNA product Design4 comprising derived and/or modified sequence from Homo sapiens__NP_000448.3__HsHNF4A (opt1)
gggagagucccgcagucggcguccagcggcucugcuuguucgugugugugucguugcaggccuuauucaagcuuaccaugcgccugagcaagacccucguggacauggacauggccgacuacuccgccgcgcuggaccccgccuacaccacgcuggaguucgagaacguccaggugcucaccaugggcaacgacaccagcccguccgaggggaccaaccugaacgcccccaacagccugggcguguccgcccucugcgccaucugcggggaccgggcgacgggcaagcacuacggggccagcuccugcgacggcugcaagggcuucuuccgccggagcguccgcaagaaccacauguacuccugccgguucagccgccagugcgugguggacaaggacaagcggaaccagugccgcuacugccggcugaagaagugcuuccgcgccgggaugaagaaggaggccguccagaacgagcgggaccgcaucuccacccggcgcagcuccuacgaggacagcucccugcccagcaucaacgcgcuccugcaggccgaggugcugucccggcagaucaccagccccguguccggcaucaacggggacauccgcgccaagaagaucgccagcaucgccgacgucugcgagagcaugaaggagcagcuccuggugcugguggagugggcgaaguacaucccggccuucugcgagcucccccuggacgaccaggucgcccugcuccgggcccacgccggcgagcaccuccugcugggggcgaccaagcgcuccaugguguucaaggacgugcugcugcucggcaacgacuacaucgucccccggcacugccccgagcuggccgagaugagccgcguguccauccggauccuggacgagcucgugcugccguuccaggagcugcagaucgacgacaacgaguacgccuaccucaaggccaucaucuucuucgaccccgacgccaagggccugagcgaccccgggaagaucaagcgccugcgcucccagguccaggugagccucgaggacuacaucaacgaccggcaguacgacucccgcggccgguucggggagcugcugcuccugcugcccacgcuccagagcaucaccuggcagaugaucgagcagauccaguucaucaagcuguucggcauggcgaagaucgacaaccugcuccaggagaugcugcugggcggguccccgagcgacgcgccccacgcccaccacccccuccacccccaccugaugcaggagcacaugggcaccaacgugaucgucgccaacaccaugccgacgcaccuguccaacgggcagaugugcgaguggccccgcccccggggccaggccgccacccccgagaccccgcagcccagcccgcccgggggcuccggcagcgagcccuacaagcuccugcccggggccguggccaccaucgugaagccccuguccgccaucccccagccgacgaucaccaagcaggaggucaucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2128 - RNA, 906 nt, Artificial Sequence
  mRNA product Design4 comprising derived and/or modified sequence from Homo sapiens__NP_061986.1__HsFGF21 (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2129 - RNA, 1632 nt, Artificial Sequence
  mRNA product Design4 comprising derived and/or modified sequence from Homo sapiens__NP_078852.3__HsOGFRL1 (opt1)
gggagagucccgcagucggcguccagcggcucugcuuguucgugugugugucguugcaggccuuauucaagcuuaccaugggcaaccugcucgggggcgugagcuuccgcgagcccaccaccgucgaggacugcgacuccacguggcagaccgacagcgagccggagcccgaggagcccgggcccggcgggggcuccgagggcccggggcaggagagcgagcagcccgcccagccgcccgagcaggccggcgggcggcccggcgcgucccccgcccccgacgaggacgccgaggccgccggggcggagcagggcggcgacagcaccgaggccaccgccaagcccaagcgcuccuucuacgccgcgcgggaccuguacaaguaccgccaccaguacccgaacuucaaggacauccgguaccagaacgaccugagcaaccuccgcuucuacaagaacaagauccccuucaagcccgacgggguguacaucgaggaggugcuguccaaguggaagggcgacuacgagaagcuggagcacaaccacacguacauccaguggcuguucccccuccgggagcaggggcugaacuucuacgccaaggagcucaccaccuacgagaucgaggaguucaagaagaccaaggaggccauccgccgguuccugcuggccuacaagaugaugcucgaguucuucggcaucaagcugacggacaagaccggcaacgucgcccgcgcggugaacuggcaggagcgguuccagcaccugaacgagagccagcacaacuaccuccgcaucacccggauccugaagucccugggggagcucggcuacgagagcuucaaguccccgcuggugaaguucauccugcacgaggcccucgucgagaacaccauccccaacaucaagcagagcgcccuggaguacuucguguacacgauccgcgaccggcgcgagcggcgcaagcugcuccgguucgcccagaagcacuacacccccuccgagaacuucaucugggggcccccgcgcaaggagcagagcgagggcuccaaggcccagaagaugagcagcccccuggcguccagccacaacucccagaccagcaugcacaagaaggccaaggacuccaagaacagcuccagcgccgugcaccugaacuccaagaccgccgaggacaagaaggucgcccccaaggagcccguggaggagacggaccggccgagccccgagcccuccaacgaggcggccaagccccgcaacaccgagaaggacagcaacgccgagaacaugaacucccagccggagaagaccgugaccacgcccaccgagaagaaggagagcgucucccccgagaacaacgaggagggcgggaacgacaaccaggacaacgagaacccgggcaacaccaacugccacgacguggugcucguccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2130 - RNA, 834 nt, Artificial Sequence
  mRNA product Design4 comprising derived and/or modified sequence from Homo sapiens__NP_008842.1__HsRLN1 (opt1)
gggagagucccgcagucggcguccagcggcucugcuuguucgugugugugucguugcaggccuuauucaagcuuaccaugccccgccuguuccucuuccaccuccuggaguucugccugcugcugaaccaguucagccgggccguggccgcgaaguggaaggacgacgucaucaagcucugcggccgcgagcuggugcgggcccagaucgccaucugcgggauguccaccuggagcaagcgcucccugagccaggaggacgccccgcagacgccccggcccguggccgagaucguccccuccuucaucaacaaggacaccgagaccaucaucaucaugcucgaguucaucgcgaaccugccgcccgagcugaaggccgcccucagcgagcgccagcccucccugcccgagcugcagcaguacgugccggcccucaaggacagcaaccuguccuucgaggaguucaagaagcugauccggaaccgccagagcgaggcggccgacuccaaccccagcgagcucaaguaccugggccuggacacccacucccagaagaagcggcgccccuacguggcccucuucgagaagugcugccugaucgggugcaccaagcggagccuggccaaguacugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2131 - RNA, 834 nt, Artificial Sequence
  mRNA product Design4 comprising derived and/or modified sequence from Homo sapiens__NP_604390.1__HsRLN2 (opt1)
gggagagucccgcagucggcguccagcggcucugcuuguucgugugugugucguugcaggccuuauucaagcuuaccaugccccgccuguucuucuuccaccuccugggcgugugccugcuccugaaccaguucagccgggccgucgccgacuccuggauggaggaggugaucaagcugugcgggcgcgagcucgugcgggcgcagaucgccaucugcggcaugagcaccugguccaagcgcagccugucccaggaggacgccccgcagacgccccggcccgucgccgagaucgugcccagcuucaucaacaaggacaccgagaccaucaacaugauguccgaguucguggccaaccugccgcaggagcucaagcugacccugagcgagaugcagcccgcgcucccccagcugcagcagcacguccccgugcugaaggacuccagccuccuguucgaggaguucaagaagcugauccgcaaccggcaguccgaggccgccgacagcuccccgagcgagcucaaguaccuggggcuggacacccacucccgcaagaagcggcagcucuacagcgcccuggcgaacaagugcugccacgugggcugcacgaagcgcucccuggcccgguucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2132 - RNA, 705 nt, Artificial Sequence
  mRNA product Design4 comprising derived and/or modified sequence from Homo sapiens__NP_543140.1__HsRLN3  (opt1)
gggagagucccgcagucggcguccagcggcucugcuuguucgugugugugucguugcaggccuuauucaagcuuaccauggcccgcuacaugcugcuccugcugcucgccguguggguccugaccggcgagcuguggcccggggcggaggcccgggccgccccguacggcgugcgccucugcgggcgggaguucauccgcgccgugaucuucacgugcggcgggagccgguggcgccgguccgacauccuggcgcacgaggccaugggcgacaccuuccccgacgccgacgccgacgaggacagccuggcgggcgagcucgacgaggccaugggguccagcgaguggcuggcccugaccaagagcccccaggccuucuaccgcggccggcccuccuggcaggggaccccgggcguccuccgcgggucccgggacgugcuggccggccugagcuccagcugcugcaaguggggcugcuccaagagcgagaucuccagccucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2133 - RNA, 1686 nt, Artificial Sequence
  mRNA product Design4 comprising derived and/or modified sequence from Homo sapiens__NP_002412.1__HsMMP1 (opt1)
gggagagucccgcagucggcguccagcggcucugcuuguucgugugugugucguugcaggccuuauucaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2134 - RNA, 1446 nt, Artificial Sequence
  mRNA product Design4 comprising derived and/or modified sequence from Homo sapiens__NP_002412.1__HsMMP1(1-19,100-469) (opt1) R6148/R6221
gggagagucccgcagucggcguccagcggcucugcuuguucgugugugugucguugcaggccuuauucaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2135 - RNA, 3633 nt, Artificial Sequence
  mRNA product Design4 comprising derived and/or modified sequence from Clostridium histolyticum__BAA77453.1__ColG (opt1)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2136 - RNA, 3357 nt, Artificial Sequence
  mRNA product Design4 comprising derived and/or modified sequence from Clostridium histolyticum__BAA77453.1__HsALB(1-18)_ColG(111-1118) (opt1) R6149/R6222
gggagagucccgcagucggcguccagcggcucugcuuguucgugugugugucguugcaggccuuauucaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2137 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2138 - RNA, 3381 nt, Artificial Sequence
  mRNA product Design4 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2139 - RNA, 3342 nt, Artificial Sequence
  mRNA product Design4 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2140 - RNA, 3276 nt, Artificial Sequence
  mRNA product Design4 comprising derived and/or modified sequence from Clostridium histolyticum__BAA34542.1__HsALB(1-18)_ColH(41-1021) (opt1) R6150/R6223
gggagagucccgcagucggcguccagcggcucugcuuguucgugugugugucguugcaggccuuauucaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2141 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2142 - RNA, 1122 nt, Artificial Sequence
  mRNA product Design4 comprising derived and/or modified sequence from Homo sapiens__NP_003801.1__HsTNFSF10 (opt2)
gggagagucccgcagucggcguccagcggcucugcuuguucgugugugugucguugcaggccuuauucaagcuuaccauggccaugauggagguccagggcggccccucccucggccagaccugcguccucaucgucaucuucaccguccuccuccagucccucugcgucgccgucaccuacgucuacuucaccaacgagcucaagcagaugcaggacaaguacuccaaguccggcaucgccugcuuccucaaggaggacgacuccuacugggaccccaacgacgaggaguccaugaacucccccugcuggcaggucaaguggcagcuccgccagcucguccgcaagaugauccuccgcaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2143 - RNA, 843 nt, Artificial Sequence
  mRNA product Design4 comprising derived and/or modified sequence from Homo sapiens__NP_003801.1__HsTNFSF10(95-281) (opt2)
gggagagucccgcagucggcguccagcggcucugcuuguucgugugugugucguugcaggccuuauucaagcuuaccaugaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2144 - RNA, 894 nt, Artificial Sequence
  mRNA product Design4 comprising derived and/or modified sequence from Homo sapiens__NP_003801.1__HsALB(1-18)_HsTNFSF10(95-281) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2145 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt2)
gggagagucccgcagucggcguccagcggcucugcuuguucgugugugugucguugcaggccuuauucaagcuuaccaugaagugggucaccuucaucucccuccucuuccucuucuccuccgccuacucccgcaugaagcagaucgaggacaagaucgaggagauccucuccaagaucuaccacaucgagaacgagaucgcccgcaucaagaagcucaucggcgagaccuccgaggagaccaucuccaccguccaggagaagcagcagaacaucuccccccucguccgcgagcgcggcccccagcgcgucgccgcccacaucaccggcacccgcggccgcuccaacacccucuccucccccaacuccaagaacgagaaggcccucggccgcaagaucaacuccugggaguccucccgcuccggccacuccuuccucuccaaccuccaccuccgcaacggcgagcucgucauccacgagaagggcuucuacuacaucuacucccagaccuacuuccgcuuccaggaggagaucaaggagaacaccaagaacgacaagcagaugguccaguacaucuacaaguacaccuccuaccccgaccccauccuccucaugaaguccgcccgcaacuccugcugguccaaggacgccgaguacggccucuacuccaucuaccagggcggcaucuucgagcucaaggagaacgaccgcaucuucgucuccgucaccaacgagcaccucaucgacauggaccacgaggccuccuucuucggcgccuuccucgucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2146 - RNA, 1353 nt, Artificial Sequence
  mRNA product Design4 comprising derived and/or modified sequence from Rattus norvegicus__NP_036656.1__RnCebpa (opt2)
gggagagucccgcagucggcguccagcggcucugcuuguucgugugugugucguugcaggccuuauucaagcuuaccauggaguccgccgacuucuacgaggccgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2147 - RNA, 1311 nt, Artificial Sequence
  mRNA product Design4 comprising derived and/or modified sequence from Rattus norvegicus__NP_036656.1__RnCebpa(15-344) (opt2)
gggagagucccgcagucggcguccagcggcucugcuuguucgugugugugucguugcaggccuuauucaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccaccccgcccccgccaugggcgccgccggccuccccggccccggcggcucccucaagggccucgccggcccccaccccgaccuccgcaccggcggcggcggcggcggcggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2148 - RNA, 1356 nt, Artificial Sequence
  mRNA product Design4 comprising derived and/or modified sequence from Mus musculus__NP_031704.2 __MmCebpa (opt2)
gggagagucccgcagucggcguccagcggcucugcuuguucgugugugugucguugcaggccuuauucaagcuuaccauggaguccgccgacuucuacgaggucgagccccgcccccccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2149 - RNA, 1314 nt, Artificial Sequence
  mRNA product Design4 comprising derived and/or modified sequence from Mus musculus__NP_031704.2 __MmCebpa(15-359) (opt2)
gggagagucccgcagucggcguccagcggcucugcuuguucgugugugugucguugcaggccuuauucaagcuuaccauguccucccaccuccagucccccccccacgcccccuccaacgccgccuucggcuucccccgcggcgccggccccgcccccccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgccggccccgccggcggcggcggcgacuucgacuaccccggcgcccccgccggccccggcggcgccgucauguccgccggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccccccacccccacgccucccccgcccaccucgccgccccccaccuccaguuccagaucgcccacugcggccagaccaccaugcaccuccagcccggccaccccacccccccccccacccccguccccuccccccacgccgcccccgcccucggcgccgccggccuccccggccccggcuccgcccucaagggccucgccggcgcccaccccgaccuccgcaccggcggcggcggcggcggcuccggcgccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2150 - RNA, 1353 nt, Artificial Sequence
  mRNA product Design4 comprising derived and/or modified sequence from Homo sapiens__NP_004355.2__HsCEBPA (opt2)
gggagagucccgcagucggcguccagcggcucugcuuguucgugugugugucguugcaggccuuauucaagcuuaccauggaguccgccgacuucuacgaggccgagccccgcccccccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2151 - RNA, 1311 nt, Artificial Sequence
  mRNA product Design4 comprising derived and/or modified sequence from Homo sapiens__NP_004355.2__HsCEBPA(15-358) (opt2)
gggagagucccgcagucggcguccagcggcucugcuuguucgugugugugucguugcaggccuuauucaagcuuaccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2152 - RNA, 1701 nt, Artificial Sequence
  mRNA product Design4 comprising derived and/or modified sequence from Homo sapiens__NP_000448.3__HsHNF4A (opt2)
gggagagucccgcagucggcguccagcggcucugcuuguucgugugugugucguugcaggccuuauucaagcuuaccaugcgccucuccaagacccucgucgacauggacauggccgacuacuccgccgcccucgaccccgccuacaccacccucgaguucgagaacguccagguccucaccaugggcaacgacaccucccccuccgagggcaccaaccucaacgcccccaacucccucggcgucuccgcccucugcgccaucugcggcgaccgcgccaccggcaagcacuacggcgccuccuccugcgacggcugcaagggcuucuuccgccgcuccguccgcaagaaccacauguacuccugccgcuucucccgccagugcgucgucgacaaggacaagcgcaaccagugccgcuacugccgccucaagaagugcuuccgcgccggcaugaagaaggaggccguccagaacgagcgcgaccgcaucuccacccgccgcuccuccuacgaggacuccucccuccccuccaucaacgcccuccuccaggccgagguccucucccgccagaucaccucccccgucuccggcaucaacggcgacauccgcgccaagaagaucgccuccaucgccgacgucugcgaguccaugaaggagcagcuccucguccucgucgagugggccaaguacauccccgccuucugcgagcucccccucgacgaccaggucgcccuccuccgcgcccacgccggcgagcaccuccuccucggcgccaccaagcgcuccauggucuucaaggacguccuccuccucggcaacgacuacaucgucccccgccacugccccgagcucgccgagaugucccgcgucuccauccgcauccucgacgagcucguccuccccuuccaggagcuccagaucgacgacaacgaguacgccuaccucaaggccaucaucuucuucgaccccgacgccaagggccucuccgaccccggcaagaucaagcgccuccgcucccagguccaggucucccucgaggacuacaucaacgaccgccaguacgacucccgcggccgcuucggcgagcuccuccuccuccuccccacccuccaguccaucaccuggcagaugaucgagcagauccaguucaucaagcucuucggcauggccaagaucgacaaccuccuccaggagaugcuccucggcggcucccccuccgacgccccccacgcccaccacccccuccacccccaccucaugcaggagcacaugggcaccaacgucaucgucgccaacaccaugcccacccaccucuccaacggccagaugugcgaguggccccgcccccgcggccaggccgccacccccgagaccccccagcccuccccccccggcggcuccggcuccgagcccuacaagcuccuccccggcgccgucgccaccaucgucaagccccucuccgccaucccccagcccaccaucaccaagcaggaggucaucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2153 - RNA, 906 nt, Artificial Sequence
  mRNA product Design4 comprising derived and/or modified sequence from Homo sapiens__NP_061986.1__HsFGF21 (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2154 - RNA, 1632 nt, Artificial Sequence
  mRNA product Design4 comprising derived and/or modified sequence from Homo sapiens__NP_078852.3__HsOGFRL1 (opt2)
gggagagucccgcagucggcguccagcggcucugcuuguucgugugugugucguugcaggccuuauucaagcuuaccaugggcaaccuccucggcggcgucuccuuccgcgagcccaccaccgucgaggacugcgacuccaccuggcagaccgacuccgagcccgagcccgaggagcccggccccggcggcggcuccgagggccccggccaggaguccgagcagcccgcccagccccccgagcaggccggcggccgccccggcgccucccccgcccccgacgaggacgccgaggccgccggcgccgagcagggcggcgacuccaccgaggccaccgccaagcccaagcgcuccuucuacgccgcccgcgaccucuacaaguaccgccaccaguaccccaacuucaaggacauccgcuaccagaacgaccucuccaaccuccgcuucuacaagaacaagauccccuucaagcccgacggcgucuacaucgaggagguccucuccaaguggaagggcgacuacgagaagcucgagcacaaccacaccuacauccaguggcucuucccccuccgcgagcagggccucaacuucuacgccaaggagcucaccaccuacgagaucgaggaguucaagaagaccaaggaggccauccgccgcuuccuccucgccuacaagaugaugcucgaguucuucggcaucaagcucaccgacaagaccggcaacgucgcccgcgccgucaacuggcaggagcgcuuccagcaccucaacgagucccagcacaacuaccuccgcaucacccgcauccucaagucccucggcgagcucggcuacgaguccuucaaguccccccucgucaaguucauccuccacgaggcccucgucgagaacaccauccccaacaucaagcaguccgcccucgaguacuucgucuacaccauccgcgaccgccgcgagcgccgcaagcuccuccgcuucgcccagaagcacuacacccccuccgagaacuucaucuggggccccccccgcaaggagcaguccgagggcuccaaggcccagaagauguccuccccccucgccuccucccacaacucccagaccuccaugcacaagaaggccaaggacuccaagaacuccuccuccgccguccaccucaacuccaagaccgccgaggacaagaaggucgcccccaaggagcccgucgaggagaccgaccgccccucccccgagcccuccaacgaggccgccaagccccgcaacaccgagaaggacuccaacgccgagaacaugaacucccagcccgagaagaccgucaccacccccaccgagaagaaggaguccgucucccccgagaacaacgaggagggcggcaacgacaaccaggacaacgagaaccccggcaacaccaacugccacgacgucguccucguccagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2155 - RNA, 834 nt, Artificial Sequence
  mRNA product Design4 comprising derived and/or modified sequence from Homo sapiens__NP_008842.1__HsRLN1 (opt2)
gggagagucccgcagucggcguccagcggcucugcuuguucgugugugugucguugcaggccuuauucaagcuuaccaugccccgccucuuccucuuccaccuccucgaguucugccuccuccucaaccaguucucccgcgccgucgccgccaaguggaaggacgacgucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaucaucaugcucgaguucaucgccaaccucccccccgagcucaaggccgcccucuccgagcgccagcccucccuccccgagcuccagcaguacguccccgcccucaaggacuccaaccucuccuucgaggaguucaagaagcucauccgcaaccgccaguccgaggccgccgacuccaaccccuccgagcucaaguaccucggccucgacacccacucccagaagaagcgccgccccuacgucgcccucuucgagaagugcugccucaucggcugcaccaagcgcucccucgccaaguacugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2156 - RNA, 834 nt, Artificial Sequence
  mRNA product Design4 comprising derived and/or modified sequence from Homo sapiens__NP_604390.1__HsRLN2 (opt2)
gggagagucccgcagucggcguccagcggcucugcuuguucgugugugugucguugcaggccuuauucaagcuuaccaugccccgccucuucuucuuccaccuccucggcgucugccuccuccucaaccaguucucccgcgccgucgccgacuccuggauggaggaggucaucaagcucugcggccgcgagcucguccgcgcccagaucgccaucugcggcauguccaccugguccaagcgcucccucucccaggaggacgccccccagaccccccgccccgucgccgagaucguccccuccuucaucaacaaggacaccgagaccaucaacaugauguccgaguucgucgccaaccucccccaggagcucaagcucacccucuccgagaugcagcccgcccucccccagcuccagcagcacguccccguccucaaggacuccucccuccucuucgaggaguucaagaagcucauccgcaaccgccaguccgaggccgccgacuccucccccuccgagcucaaguaccucggccucgacacccacucccgcaagaagcgccagcucuacuccgcccucgccaacaagugcugccacgucggcugcaccaagcgcucccucgcccgcuucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2157 - RNA, 705 nt, Artificial Sequence
  mRNA product Design4 comprising derived and/or modified sequence from Homo sapiens__NP_543140.1__HsRLN3  (opt2)
gggagagucccgcagucggcguccagcggcucugcuuguucgugugugugucguugcaggccuuauucaagcuuaccauggcccgcuacaugcuccuccuccuccucgccgucuggguccucaccggcgagcucuggcccggcgccgaggcccgcgccgcccccuacggcguccgccucugcggccgcgaguucauccgcgccgucaucuucaccugcggcggcucccgcuggcgccgcuccgacauccucgcccacgaggccaugggcgacaccuuccccgacgccgacgccgacgaggacucccucgccggcgagcucgacgaggccaugggcuccuccgaguggcucgcccucaccaaguccccccaggccuucuaccgcggccgccccuccuggcagggcacccccggcguccuccgcggcucccgcgacguccucgccggccucuccuccuccugcugcaaguggggcugcuccaaguccgagaucuccucccucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2158 - RNA, 1686 nt, Artificial Sequence
  mRNA product Design4 comprising derived and/or modified sequence from Homo sapiens__NP_002412.1__HsMMP1 (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2159 - RNA, 1446 nt, Artificial Sequence
  mRNA product Design4 comprising derived and/or modified sequence from Homo sapiens__NP_002412.1__HsMMP1(1-19,100-469) (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2160 - RNA, 3633 nt, Artificial Sequence
  mRNA product Design4 comprising derived and/or modified sequence from Clostridium histolyticum__BAA77453.1__ColG (opt2)
gggagagucccgcagucggcguccagcggcucugcuuguucgugugugugucguugcaggccuuauucaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2161 - RNA, 3357 nt, Artificial Sequence
  mRNA product Design4 comprising derived and/or modified sequence from Clostridium histolyticum__BAA77453.1__HsALB(1-18)_ColG(111-1118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2162 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2163 - RNA, 3381 nt, Artificial Sequence
  mRNA product Design4 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2164 - RNA, 3342 nt, Artificial Sequence
  mRNA product Design4 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2165 - RNA, 3276 nt, Artificial Sequence
  mRNA product Design4 comprising derived and/or modified sequence from Clostridium histolyticum__BAA34542.1__HsALB(1-18)_ColH(41-1021) (opt2)
gggagagucccgcagucggcguccagcggcucugcuuguucgugugugugucguugcaggccuuauucaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2166 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2167 - RNA, 1122 nt, Artificial Sequence
  mRNA product Design4 comprising derived and/or modified sequence from Homo sapiens__NP_003801.1__HsTNFSF10 (opt3)
gggagagucccgcagucggcguccagcggcucugcuuguucgugugugugucguugcaggccuuauucaagcuuaccauggccaugauggaggugcagggcgggcccagccugggacaaaccugcguccucaucguuauuuucacagugcuucugcaguccuuguguguagcugugacuuacgucuauuuuacgaacgaauuaaagcagaugcaggacaaauacucuaagucagguauagcaugcuuccugaaagaggaugacaguuauugggauccuaaugacgaagagagcaugaacuccccauguuggcaagugaaguggcagcuaagacagcucguuaggaaaaugauccugcggaccucugaagagacaauuucgacugugcaggagaagcaacagaauaucucaccgcuuguccgcgaacgaggcccccagcguguggccgcgcacauuaccgggacaagaggaaggagcaacacccugaguuccccuaauucuaagaacgagaaggcuuugggccggaaaaucaauagcugggaauccucacgcaguggucauagcuuucucucuaaccugcaccugagaaauggggagcucguaauacaugagaaaggauucuacuauaucuacucccagacuuauuuuagguuccaagaagagauuaaggaaaacaccaaaaaugauaagcagaugguucaguacaucuacaaguauacaucauacccagaccccauuuuacugaugaaaagcgcccggaacaguugcuggucuaaggaugcagaguauggccuuuacuccaucuaucaaggcgggauauuugaauugaaagagaaugaccgcauuuucgugagcgucacgaacgagcaccugaucgauauggaccaugaagccucguuuuucggagcuuuucuaguggguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2168 - RNA, 843 nt, Artificial Sequence
  mRNA product Design4 comprising derived and/or modified sequence from Homo sapiens__NP_003801.1__HsTNFSF10(95-281) (opt3)
gggagagucccgcagucggcguccagcggcucugcuuguucgugugugugucguugcaggccuuauucaagcuuaccaugaccagcgaagaaacaaucuccacugugcaggagaagcaacagaacauuucuccccuggucagagaaaggggcccucagcggguugccgcucacauaacggggacccgcggacgaucaaauacacucaguagcccaaacuccaaaaaugagaaggcacuuggucguaaaaucaacucuugggaaucgucaagaagcggccauaguuuccuguccaauuugcacuuaaggaacggggagcuggugauucaugagaagggauuuuacuauaucuacucucagacuuauuuccgguuucaagaagagauuaaagaaaauaccaagaacgacaagcagaugguacaguacaucuauaaauacacaagcuauccggaucccauacuacucaugaaguccgcccgcaauucaugcuggaguaaagacgcggaguacggccuguacagcaucuaucagggugggauuuucgagcuuaaggaaaacgauagaaucuuugugucugucaccaaugagcaccugauugacauggaucaugaggcuuccuucuuuggagccuucuuggugggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2169 - RNA, 894 nt, Artificial Sequence
  mRNA product Design4 comprising derived and/or modified sequence from Homo sapiens__NP_003801.1__HsALB(1-18)_HsTNFSF10(95-281) (opt3)
gggagagucccgcagucggcguccagcggcucugcuuguucgugugugugucguugcaggccuuauucaagcuuaccaugaagugggugaccuucaucagccugcucuuucuuuucuccucugccuacucaacaagugaggaaacuauuagcacgguccaggagaaacaacagaacauaucuccccugguuagagaaaggggcccucagcggguggcugcacacaucaccgggacacgcggacgaucuaauacuuugucgucaccaaacagcaagaaugagaaagccuuaggucguaagauuaacaguugggaauccucuagaagcggccauuccuuucugucaaaucuacaccucaggaacggggagcugguaauccaugagaaaggauucuauuacauuuauagucagaccuacuuucgguuccaagaagagaucaaggaaaauacaaagaacgacaaacagauggugcaguauauauacaaguauaccagcuacccggaucccauccuucugaugaaaucugcgcgcaauuccugcuggucaaaggacgcugaguacggcuuguauagcauuuaccagggugggaucuuugagcucaaagaaaacgauagaauuuucgucagugugacuaaugagcaccugaucgacauggaucaugaagccuccuuuuucggagcauuucugguuggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2170 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt3)
gggagagucccgcagucggcguccagcggcucugcuuguucgugugugugucguugcaggccuuauucaagcuuaccaugaagugggugaccuucaucagccugcucuuucuuuucuccucugccuacucaagaaugaaacagauugaggacaagauagaagagauccugaguaaaauuuaucacaucgaaaacgagauugcuaggaucaagaaauugauaggcgaaacaagcgaggagacuaucuccacgguccaagaaaagcagcagaauauuucucccuuaguucgggagcgcgggccucagcgaguggcagcccauaucaccggaacacgugguagaucgaacacucugucaagcccaaauaguaagaacgaaaaagcgcuaggcaggaagauuaauuccugggagucuagccgguccgggcacucauuucucaguaaccugcaucuucgcaauggagagcugguaauccacgaaaaaggcuucuacuauauauacagccaaaccuauuuuagauuccaggaggaaauuaaggagaacaccaaaaaugauaagcagauggugcaguacaucuauaaguacacaucuuacccggaccccauuuugcucaugaaauccgcuaggaacucaugcuggagcaaggaugccgaauauggucuguacaguaucuaucaagggggaaucuuugagcugaaagagaaugaccggauuuucgucucugugacuaacgaacaucucauagauauggaccacgaggcauccuuuuucggcgccuuuuuaguuggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2171 - RNA, 1353 nt, Artificial Sequence
  mRNA product Design4 comprising derived and/or modified sequence from Rattus norvegicus__NP_036656.1__RnCebpa (opt3)
gggagagucccgcagucggcguccagcggcucugcuuguucgugugugugucguugcaggccuuauucaagcuuaccauggagagcgccgacuucuacgaagcugagcccagaccuccaauguccucucaucugcagucaccgccccacgcaccuaguaacgccgcguuuggcuucccaaggggagcugggcccgccccuccacccgcaccuccagccgcuccggaaccccucgguggcaucugcgagcacgaaaccagcauugauauauccgcauauaucgacccugccgcuuuuaaugaugaguuccuugccgaccuguuucaacauucucggcagcaggagaaggcgaaagcagccgcugggccagccggaggcgguggggauuucgacuaccccggagcuccugcaggcccaggcggggccgugaugucggcgggagcccacggucccccgccuggcuaugggugugcagcugccggauacuuggauggccgcuuagaaccccuguaugagcgagucggugcuccagcccuacguccucucguuauuaagcaggaacccagagaggaggacgaagcaaaacaacuggcccuugcugggcuguuuccauaccagcccccuccaccgcccccuccaccccauccucacgcgucaccagcacacuuggccgcuccccaucuccaguuccagaucgcccacugcggacaaacaacuaugcaucugcagccgggccacccuacgccacccccuacccccgugccaagcccucaccccgcaccagccaugggcgcugccgggcugccgggaccugguggcagucucaagggguuagcaggaccccauccagaucugaggacaggcggugggggcggaggcggggcgggagcugguaaagccaagaaguccguagacaaaaacucuaaugaguaucgggugcgcagagaaaggaacaauauugcaguccgcaagagccgggauaaagccaagcagcgaaacguggagacucagcaaaaaguucuugaauugaccuccgacaaugauagacugaggaagcggguggagcagcuaucacgugagcucgacacacugcgcggcaucuuuagacagcuucccgaaaguagccuggucaaggcuauggggaacugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2172 - RNA, 1311 nt, Artificial Sequence
  mRNA product Design4 comprising derived and/or modified sequence from Rattus norvegicus__NP_036656.1__RnCebpa(15-344) (opt3)
gggagagucccgcagucggcguccagcggcucugcuuguucgugugugugucguugcaggccuuauucaagcuuaccaugagcucccaucugcagucucccccucacgccccaucaaacgcugcauucggcuuuccgagaggggccggacccgcgccuccacccgcuccuccagccgcacccgagccucucgguggcaucugcgaacacgagaccaguauugacauaagcgccuacaucgauccagcugcauucaaugacgaauuucuugccgaucuguuccaacauuccaggcagcaggagaaggcuaaagccgcggcagggccggccggaggcgguggggacuuugauuaucccggagcuccugccggcccaggcggggcagugaugucugcuggagcccacggucccccuccaggcuacgggugugcggccgcaggauauuuggacggccgguuagaaccccuguacgagcgcgucggugcuccggcccuacgaccucucguuauuaagcaggagccccgugaagaggaugaagcuaaacaacuggcccuugcagggcuguucccauaucagccucccccacccccuccaccgccccauccucacgccucgccagcucacuuggcggcaccccaucuccaguuucagaucgcccacugcggacaaacaacuaugcaucugcagccuggccacccaacgcccccgccuaccccagugcccucaccucaccccgcuccagccaugggcgcagccgggcugccuggacccgguggcagccucaagggguuagcuggaccacauccggaccugagaacaggcggugggggcggaggcggggccggagcagguaaagcgaagaagaguguagauaaaaacuccaaugaguacagggugcggcgcgagagaaacaauauugcugucaggaagucucgggacaaagccaagcagcgcaacguggaaacucagcaaaaaguucuugaguugaccagcgauaaugaccgacugagaaagaggguggaacagcuaucccgggagcucgauacacugcguggcaucuuccgccagcuuccugaaucaagucuggucaaggcaauggggaacugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2173 - RNA, 1356 nt, Artificial Sequence
  mRNA product Design4 comprising derived and/or modified sequence from Mus musculus__NP_031704.2 __MmCebpa (opt3) R6153/R6225
gggagagucccgcagucggcguccagcggcucugcuuguucgugugugugucguugcaggccuuauucaagcuuaccauggaaagcgccgacuucuacgagguggaacccagaccuccuaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2174 - RNA, 1314 nt, Artificial Sequence
  mRNA product Design4 comprising derived and/or modified sequence from Mus musculus__NP_031704.2 __MmCebpa(15-359) (opt3)
gggagagucccgcagucggcguccagcggcucugcuuguucgugugugugucguugcaggccuuauucaagcuuaccaugagcagccaucugcagucuccaccucacgcuccuagcaaugccgccuuuggauuuccuagaggcgcuggaccugcuccuccaccagcuccuccagcugcaccugaaccucucggaggcaucugugaacacgaaaccagcaucgacaucagcgccuacaucgacccugccgccuucaaugaugaguuccuggccgaucuguuccagcacagcagacagcaagagaaggccaaagcugcugcuggaccagcuggcggaggcggcgauuuugauuauccuggugcuccagcaggacccggcggagcuguuaugucugcuggugcacauggcccuccaccuggauauggaugugccgccgcuggauaucuggacggcagacuggaaccucuguacgagagaguuggagccccugcucugaggccccugguuaucaagcaagagcccagagaagaggacgaggccaaacaacuugcccuggccggccuguuuccuuaccaaccuccgccaccuccaccaccaccucauccucaugcuucuccagcucaucuggccgcuccucaccuccaguuucagauugcccacuguggccagaccaccaugcaucugcaaccuggacaucccacaccaccuccaacuccagugccuucuccacaugcagcuccagcucuuggagcagcuggacuuccuggaccuggaucugcucugaaaggacuggcuggcgcccauccugaucuuagaacaggcgguggcggcggaggaagcggagcuggcgcuggaaaagccaagaaaagcguggacaagaacagcaacgaguacagagugcggagagagcggaacaauaucgccgugcgcaagagcagagacaaggccaagcagagaaacguggaaacccagcagaaggugcucgagcugaccagcgacaacgaccggcugagaaagagaguggaacagcugagcagagagcuggacacccugagaggcaucuucagacagcugccugagucuagccuggucaaggccaugggcaauugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2175 - RNA, 1353 nt, Artificial Sequence
  mRNA product Design4 comprising derived and/or modified sequence from Homo sapiens__NP_004355.2__HsCEBPA (opt3)
gggagagucccgcagucggcguccagcggcucugcuuguucgugugugugucguugcaggccuuauucaagcuuaccauggagagcgccgacuucuacgaagcugagcccagaccuccaauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2176 - RNA, 1311 nt, Artificial Sequence
  mRNA product Design4 comprising derived and/or modified sequence from Homo sapiens__NP_004355.2__HsCEBPA(15-358) (opt3)
gggagagucccgcagucggcguccagcggcucugcuuguucgugugugugucguugcaggccuuauucaagcuuaccauguccucucaucugcagucaccgccccacgcaccuaguagcgccgcguuuggcuucccaaggggagcugggcccgcccaaccuccagcacccccugccgcuccagaaccgcucgguggcaucugcgagcacgaaaccuccauugauauaucugcauauaucgaccccgccgcuuuuaacgaugaguuccuugccgaccuguuucagcauucgcggcagcaggagaaggcgaaagcagccguggggccuacaggaggcggugggggaggcgauuucgacuacccaggcgcucccgccgggccuggaggugcagucaugccaggcggggcucacggacccccgccuggcuaugguugugccgcggccggguacuuggauggacgcuuagaaccccuguaugagcgaguuggcgcaccagcucuacguccucucgugauuaagcaagaacccagagaggaggacgaagccaaacagcuggcucuugccggccuguuuccauaccagcccccuccaccgcccccuccaucacauccccacccucacccacccccggcacauuuggccgcuccucaccuccaguuccaaaucgcgcauugcgggcagacuacgaugcaucugcagccaggacaccccaccccucccccaacaccuguacccagcccacacccggccccugcacugggugcugccggccuccccgggccaggaagugcauuaaagggccugggugccgcucaccccgaucuuagggccuccgggggcucuggagcaggcaaagcgaagaaguccguggacaaaaauagcaacgaguaucggguccgcagagaaaggaauaacauugcugugcggaagucacgcgauaaagccaagcagcgaaauguugagacucaacagaaaguguuggaacugaccagugacaacgauagacuaaggaagcgggucgagcagcucagccgugagcuggacacacuucgcgggaucuuuagacaacugccugaaucuuccuuggugaaggcaaugggaaauugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2177 - RNA, 1701 nt, Artificial Sequence
  mRNA product Design4 comprising derived and/or modified sequence from Homo sapiens__NP_000448.3__HsHNF4A (opt3)
gggagagucccgcagucggcguccagcggcucugcuuguucgugugugugucguugcaggccuuauucaagcuuaccaugagacugagcaagacccucguggacauggauauggccgacuacuccgcugcacuugaucccgccuauacaacucuggaguucgaaaacguccagguuuugacgaugggcaaugacaccucuccuucagaggggacaaacuuaaaugcgccaaacagucugggagugagcgcucuaugcgccaucuguggugauagggcaacuggcaaacacuacggggccuccucuugcgacggauguaagggcuuuuuccggcgcucgguacguaaaaaucauauguauucaugccgauuuagcagacaauguguggucgauaaggacaaaaggaaccagugccgguacugucgccucaagaagugcuucagagcugguaugaaaaaggaagcagugcagaaugagagggaucggauuaguacccgccgauccucuuaugaagacagcucccugccgucaauaaacgcccuucugcaggcugagguuuugaguagacaaaucacaagccccgugucugggauuaauggagauaucagggccaaaaagauugcguccaucgcagacgucugugagucaaugaaagaacagcuccuggugcugguagagugggccaaguacauaccugcuuuuugcgaacucccauuagaugaccagguugcccugcuucgggcacacgcuggcgagcauuugcugcuaggcgccaccaagcguagcaugguguucaaagacguccuccugcuugggaacgauuauaucgugccccgccacuguccugagcuggcggaaaugaguagagugucuauuaggaucuuggacgagcucguccugccauuucaggaauuacaaauugaugacaaugaguacgccuaccugaaggcaaucauauucuuugaucccgacgcuaaaggacucuccgauccugguaagauuaaacggcuucgaagccagguucaggugucgcuggaagacuauaucaacgaucgccaguacgacucuagaggcagguucggggaguugcuacugcuccugccaacucuucaauccauuacauggcagaugaucgagcagauccaauuuauuaagcuguucggaauggccaaaauagauaauuugcuccaggaaaugcuguuaggcgguucaccgagugacgcuccccaugcccaccacccucugcauccacaccuaaugcaggagcauauggggaccaacguaaucguggcaaauacgaugcccacucaccucagcaacggacagaugugcgaauggccucggccacgcggccaagccgcuacccccgagacaccgcagccuucucccccaggcggguccggaagcgaaccuuauaagcugcuucccggugcggucgcaacuauugugaagccauugucagccaucccccagccuaccauaacaaaacaggagguuauuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2178 - RNA, 906 nt, Artificial Sequence
  mRNA product Design4 comprising derived and/or modified sequence from Homo sapiens__NP_061986.1__HsFGF21 (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2179 - RNA, 1632 nt, Artificial Sequence
  mRNA product Design4 comprising derived and/or modified sequence from Homo sapiens__NP_078852.3__HsOGFRL1 (opt3)
gggagagucccgcagucggcguccagcggcucugcuuguucgugugugugucguugcaggccuuauucaagcuuaccaugggcaaccugcucgggggagugagcuucagagagcccaccacagucgaagacugcgauuccacuuggcagacggacucugagccugaaccagaggaaccgggucccggcgggggaucagagggcccuggucaagagagugaacagccagcccagcccccugagcaggcugggggaaggccaggcgcaagccccgccccugaugaagacgcggaggcugccggcgcagagcaagggggagauuccaccgaagccacagcuaagccaaaacggucuuuuuacgcagcccgcgaccuuuauaaguaccgacaccaguauccgaauuucaaagauauccguuaccagaacgaccugucgaauuugagauuuuauaagaacaaaauucccuucaagccugaugguguuuacauagaggaaguguuaucaaaguggaaaggcgacuaugagaagcuggaacauaaucacacuuacauccaguggcuauuuccacucagggagcaagggcugaacuucuacgcuaaagagcuuaccacauaugaaauugaggaauuuaagaaaaccaaggaggccauccggcgcuuccuguuggcguacaagaugaugcucgaauuuuucggaauuaaacugacugauaagacaggcaauguagcaagagccgugaacuggcaggagagguuucagcaucugaaugagagccagcacaacuaucuccggaucacccgcauauuaaaaagucugggugaacuuggguacgaguccuucaagucucccuuggucaaauuuauccugcaugaagcucuaguggagaauacgauuccuaacaucaagcaaagcgcccucgaauauuucguuuacacuauucgagacagaagggagcggcguaaacugcuucgcuucgcacagaagcacuauaccccauccgagaauuuuaucuggggacccccgagaaaggaacagucagagggcaguaaagcucaaaagaugagcucuccucuggccuccucacacaacagccagacaaguaugcauaaaaaggcgaaagauucuaaaaauuccagcucggccgugcacuugaacucuaagacugcagaagacaagaaggucgcucccaaagagccaguggaggaaaccgacaggccuucccccgagccaucaaacgaagccgcuaagccccggaauacagagaaagauaguaacgccgaaaauaugaacagccagccugagaagaccguaacgacuccaacagagaagaaagaauccguuucuccggagaauaacgaagagggcgggaaugacaaccaggauaaugaaaaccccggaaauaccaacugucaugacgugguccucgugcaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2180 - RNA, 834 nt, Artificial Sequence
  mRNA product Design4 comprising derived and/or modified sequence from Homo sapiens__NP_008842.1__HsRLN1 (opt3)
gggagagucccgcagucggcguccagcggcucugcuuguucgugugugugucguugcaggccuuauucaagcuuaccaugcccagacuguuccucuuucaccuucuggaguucugcuuguuacugaaccaguuuagcagggccguggcugcaaaguggaaagacgaugucaucaagcuauguggccgggaacucguucgcgcccaaauugcgauaugcgggauguccaccuggucuaaacgaucacugagucaggaggacgcuccucagacaccacguccgguggccgaaaucguacccagcuucauuaauaaggauacugagacgaucauuaucaugcuugaauuuauagcaaaccugccuccagaguugaaagccgcucucuccgagagacagcccucucugccugaacugcaacaguacgugccagcacucaaggacucgaauuuaucauucgaggaauuuaagaaacugaucaggaaccggcagagcgaggccgcugauaguaaucccuccgagcuuaaguauuugggacuggacacccauucucagaaaaagcgcagaccuuacgucgcccuauucgaaaaauguugccucauugguuguacaaagaggagccuggcgaaguauugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2181 - RNA, 834 nt, Artificial Sequence
  mRNA product Design4 comprising derived and/or modified sequence from Homo sapiens__NP_604390.1__HsRLN2 (opt3)
gggagagucccgcagucggcguccagcggcucugcuuguucgugugugugucguugcaggccuuauucaagcuuaccaugcccagacuguucuuuuuccaccuccuuggcgugugccuguuguuaaaccaguuuagcagggccgucgcugacuccuggauggaggaaguuaucaagcugugugggcgggagcuagugcgcgcacaaauugccauaugcggaaugucuaccuggucaaaacgaagucucagccaggaagaugcgccucagacaccacguccgguagcugagaucgugcccuccuucauuaauaaggacacugaaacgaucaacaugaugucugaguuugucgccaaucugccucaggagcuuaaacugaccuugucggaaaugcaaccagcacucccccagcugcagcagcaugugccuguucugaaggauucaagccucuuauucgaggaauuuaaaaagcugauuagaaacaggcaaagugaggccgcugacuccucuccaagcgagcuuaaguacuugggucuggauacacacucccggaaaaagcgccagcuauauucagcacucgccaauaaauguugccaugugggcuguacuaagagaagucuggcuagguucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2182 - RNA, 705 nt, Artificial Sequence
  mRNA product Design4 comprising derived and/or modified sequence from Homo sapiens__NP_543140.1__HsRLN3  (opt3)
gggagagucccgcagucggcguccagcggcucugcuuguucgugugugugucguugcaggccuuauucaagcuuaccauggccagauacaugcugcuccuucuguuggcugugugggucuuaaccggcgagcuguggcccggggcagaagccagggcggcuccuuauggaguucggcuaugcggucgcgaguucauccgagccgugauuuuuacauguggcgggagccguuggagaagguccgacauacucgcacacgaagccaugggagauacuuucccagacgcugaugcagacgaggauucucuggccggcgaacuugacgaggcuauggguucaagugaguggcuggccuugaccaagagcccgcaggcguuuuaccgggggcgccccuccuggcaaggaacgccuggcguacucagaggcucuagggaugugcuggcagggcugucgucaagcugcuguaaauggggaugcaguaaguccgaaaucucuagccucuguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2183 - RNA, 1686 nt, Artificial Sequence
  mRNA product Design4 comprising derived and/or modified sequence from Homo sapiens__NP_002412.1__HsMMP1 (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2184 - RNA, 1446 nt, Artificial Sequence
  mRNA product Design4 comprising derived and/or modified sequence from Homo sapiens__NP_002412.1__HsMMP1(1-19,100-469) (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2185 - RNA, 3633 nt, Artificial Sequence
  mRNA product Design4 comprising derived and/or modified sequence from Clostridium histolyticum__BAA77453.1__ColG (opt3)
gggagagucccgcagucggcguccagcggcucugcuuguucgugugugugucguugcaggccuuauucaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2186 - RNA, 3357 nt, Artificial Sequence
  mRNA product Design4 comprising derived and/or modified sequence from Clostridium histolyticum__BAA77453.1__HsALB(1-18)_ColG(111-1118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2187 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2188 - RNA, 3381 nt, Artificial Sequence
  mRNA product Design4 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2189 - RNA, 3342 nt, Artificial Sequence
  mRNA product Design4 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2190 - RNA, 3276 nt, Artificial Sequence
  mRNA product Design4 comprising derived and/or modified sequence from Clostridium histolyticum__BAA34542.1__HsALB(1-18)_ColH(41-1021) (opt3)
gggagagucccgcagucggcguccagcggcucugcuuguucgugugugugucguugcaggccuuauucaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2191 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2192 - RNA, 1122 nt, Artificial Sequence
  mRNA product Design4 comprising derived and/or modified sequence from Homo sapiens__NP_003801.1__HsTNFSF10 (opt4)
gggagagucccgcagucggcguccagcggcucugcuuguucgugugugugucguugcaggccuuauucaagcuuaccauggccaugauggaggugcagggcggccccagccugggccagaccugcgugcugaucgugaucuucaccgugcugcugcagagccugugcguggccgugaccuacguguacuucaccaacgagcugaagcagaugcaggacaaguacagcaagagcggcaucgccugcuuccugaaggaggacgacagcuacugggaccccaacgacgaggagagcaugaacagccccugcuggcaggugaaguggcagcugagacagcuggugagaaagaugauccugagaaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2193 - RNA, 843 nt, Artificial Sequence
  mRNA product Design4 comprising derived and/or modified sequence from Homo sapiens__NP_003801.1__HsTNFSF10(95-281) (opt4)
gggagagucccgcagucggcguccagcggcucugcuuguucgugugugugucguugcaggccuuauucaagcuuaccaugaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2194 - RNA, 894 nt, Artificial Sequence
  mRNA product Design4 comprising derived and/or modified sequence from Homo sapiens__NP_003801.1__HsALB(1-18)_HsTNFSF10(95-281) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2195 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt4)
gggagagucccgcagucggcguccagcggcucugcuuguucgugugugugucguugcaggccuuauucaagcuuaccaugaagugggugaccuucaucagccugcuguuccuguucagcagcgccuacagcagaaugaagcagaucgaggacaagaucgaggagauccugagcaagaucuaccacaucgagaacgagaucgccagaaucaagaagcugaucggcgagaccagcgaggagaccaucagcaccgugcaggagaagcagcagaacaucagcccccuggugagagagagaggcccccagagaguggccgcccacaucaccggcaccagaggcagaagcaacacccugagcagccccaacagcaagaacgagaaggcccugggcagaaagaucaacagcugggagagcagcagaagcggccacagcuuccugagcaaccugcaccugagaaacggcgagcuggugauccacgagaagggcuucuacuacaucuacagccagaccuacuucagauuccaggaggagaucaaggagaacaccaagaacgacaagcagauggugcaguacaucuacaaguacaccagcuaccccgaccccauccugcugaugaagagcgccagaaacagcugcuggagcaaggacgccgaguacggccuguacagcaucuaccagggcggcaucuucgagcugaaggagaacgacagaaucuucgugagcgugaccaacgagcaccugaucgacauggaccacgaggccagcuucuucggcgccuuccuggugggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2196 - RNA, 1353 nt, Artificial Sequence
  mRNA product Design4 comprising derived and/or modified sequence from Rattus norvegicus__NP_036656.1__RnCebpa (opt4)
gggagagucccgcagucggcguccagcggcucugcuuguucgugugugugucguugcaggccuuauucaagcuuaccauggagagcgccgacuucuacgaggccgagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2197 - RNA, 1311 nt, Artificial Sequence
  mRNA product Design4 comprising derived and/or modified sequence from Rattus norvegicus__NP_036656.1__RnCebpa(15-344) (opt4)
gggagagucccgcagucggcguccagcggcucugcuuguucgugugugugucguugcaggccuuauucaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccaccccgcccccgccaugggcgccgccggccugcccggccccggcggcagccugaagggccuggccggcccccaccccgaccugagaaccggcggcggcggcggcggcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2198 - RNA, 1356 nt, Artificial Sequence
  mRNA product Design4 comprising derived and/or modified sequence from Mus musculus__NP_031704.2 __MmCebpa (opt4)
gggagagucccgcagucggcguccagcggcucugcuuguucgugugugugucguugcaggccuuauucaagcuuaccauggagagcgccgacuucuacgagguggagcccagaccccccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2199 - RNA, 1314 nt, Artificial Sequence
  mRNA product Design4 comprising derived and/or modified sequence from Mus musculus__NP_031704.2 __MmCebpa(15-359) (opt4)
gggagagucccgcagucggcguccagcggcucugcuuguucgugugugugucguugcaggccuuauucaagcuuaccaugagcagccaccugcagagccccccccacgcccccagcaacgccgccuucggcuuccccagaggcgccggccccgcccccccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgccggccccgccggcggcggcggcgacuucgacuaccccggcgcccccgccggccccggcggcgccgugaugagcgccggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccccccacccccacgccagccccgcccaccuggccgccccccaccugcaguuccagaucgcccacugcggccagaccaccaugcaccugcagcccggccaccccacccccccccccacccccgugcccagcccccacgccgcccccgcccugggcgccgccggccugcccggccccggcagcgcccugaagggccuggccggcgcccaccccgaccugagaaccggcggcggcggcggcggcagcggcgccggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2200 - RNA, 1353 nt, Artificial Sequence
  mRNA product Design4 comprising derived and/or modified sequence from Homo sapiens__NP_004355.2__HsCEBPA (opt4)
gggagagucccgcagucggcguccagcggcucugcuuguucgugugugugucguugcaggccuuauucaagcuuaccauggagagcgccgacuucuacgaggccgagcccagaccccccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2201 - RNA, 1311 nt, Artificial Sequence
  mRNA product Design4 comprising derived and/or modified sequence from Homo sapiens__NP_004355.2__HsCEBPA(15-358) (opt4)
gggagagucccgcagucggcguccagcggcucugcuuguucgugugugugucguugcaggccuuauucaagcuuaccaugagcagccaccugcagagccccccccacgcccccagcagcgccgccuucggcuuccccagaggcgccggccccgcccagccccccgccccccccgccgcccccgagccccugggcggcaucugcgagcacgagaccagcaucgacaucagcgccuacaucgaccccgccgccuucaacgacgaguuccuggccgaccuguuccagcacagcagacagcaggagaaggccaaggccgccgugggccccaccggcggcggcggcggcggcgacuucgacuaccccggcgcccccgccggccccggcggcgccgugaugcccggcggcgcccacggccccccccccggcuacggcugcgccgccgccggcuaccuggacggcagacuggagccccuguacgagagagugggcgcccccgcccugagaccccuggugaucaagcaggagcccagagaggaggacgaggccaagcagcuggcccuggccggccuguuccccuaccagcccccccccccccccccccccagccacccccacccccaccccccccccgcccaccuggccgccccccaccugcaguuccagaucgcccacugcggccagaccaccaugcaccugcagcccggccaccccacccccccccccacccccgugcccagcccccaccccgcccccgcccugggcgccgccggccugcccggccccggcagcgcccugaagggccugggcgccgcccaccccgaccugagagccagcggcggcagcggcgccggcaaggccaagaagagcguggacaagaacagcaacgaguacagagugagaagagagagaaacaacaucgccgugagaaagagcagagacaaggccaagcagagaaacguggagacccagcagaaggugcuggagcugaccagcgacaacgacagacugagaaagagaguggagcagcugagcagagagcuggacacccugagaggcaucuucagacagcugcccgagagcagccuggugaaggccaugggcaacugcgccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2202 - RNA, 1701 nt, Artificial Sequence
  mRNA product Design4 comprising derived and/or modified sequence from Homo sapiens__NP_000448.3__HsHNF4A (opt4)
gggagagucccgcagucggcguccagcggcucugcuuguucgugugugugucguugcaggccuuauucaagcuuaccaugagacugagcaagacccugguggacauggacauggccgacuacagcgccgcccuggaccccgccuacaccacccuggaguucgagaacgugcaggugcugaccaugggcaacgacaccagccccagcgagggcaccaaccugaacgcccccaacagccugggcgugagcgcccugugcgccaucugcggcgacagagccaccggcaagcacuacggcgccagcagcugcgacggcugcaagggcuucuucagaagaagcgugagaaagaaccacauguacagcugcagauucagcagacagugcgugguggacaaggacaagagaaaccagugcagauacugcagacugaagaagugcuucagagccggcaugaagaaggaggccgugcagaacgagagagacagaaucagcaccagaagaagcagcuacgaggacagcagccugcccagcaucaacgcccugcugcaggccgaggugcugagcagacagaucaccagccccgugagcggcaucaacggcgacaucagagccaagaagaucgccagcaucgccgacgugugcgagagcaugaaggagcagcugcuggugcugguggagugggccaaguacauccccgccuucugcgagcugccccuggacgaccagguggcccugcugagagcccacgccggcgagcaccugcugcugggcgccaccaagagaagcaugguguucaaggacgugcugcugcugggcaacgacuacaucgugcccagacacugccccgagcuggccgagaugagcagagugagcaucagaauccuggacgagcuggugcugcccuuccaggagcugcagaucgacgacaacgaguacgccuaccugaaggccaucaucuucuucgaccccgacgccaagggccugagcgaccccggcaagaucaagagacugagaagccaggugcaggugagccuggaggacuacaucaacgacagacaguacgacagcagaggcagauucggcgagcugcugcugcugcugcccacccugcagagcaucaccuggcagaugaucgagcagauccaguucaucaagcuguucggcauggccaagaucgacaaccugcugcaggagaugcugcugggcggcagccccagcgacgccccccacgcccaccacccccugcacccccaccugaugcaggagcacaugggcaccaacgugaucguggccaacaccaugcccacccaccugagcaacggccagaugugcgaguggcccagacccagaggccaggccgccacccccgagaccccccagcccagcccccccggcggcagcggcagcgagcccuacaagcugcugcccggcgccguggccaccaucgugaagccccugagcgccaucccccagcccaccaucaccaagcaggaggugaucugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2203 - RNA, 906 nt, Artificial Sequence
  mRNA product Design4 comprising derived and/or modified sequence from Homo sapiens__NP_061986.1__HsFGF21 (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2204 - RNA, 1632 nt, Artificial Sequence
  mRNA product Design4 comprising derived and/or modified sequence from Homo sapiens__NP_078852.3__HsOGFRL1 (opt4)
gggagagucccgcagucggcguccagcggcucugcuuguucgugugugugucguugcaggccuuauucaagcuuaccaugggcaaccugcugggcggcgugagcuucagagagcccaccaccguggaggacugcgacagcaccuggcagaccgacagcgagcccgagcccgaggagcccggccccggcggcggcagcgagggccccggccaggagagcgagcagcccgcccagccccccgagcaggccggcggcagacccggcgccagccccgcccccgacgaggacgccgaggccgccggcgccgagcagggcggcgacagcaccgaggccaccgccaagcccaagagaagcuucuacgccgccagagaccuguacaaguacagacaccaguaccccaacuucaaggacaucagauaccagaacgaccugagcaaccugagauucuacaagaacaagauccccuucaagcccgacggcguguacaucgaggaggugcugagcaaguggaagggcgacuacgagaagcuggagcacaaccacaccuacauccaguggcuguucccccugagagagcagggccugaacuucuacgccaaggagcugaccaccuacgagaucgaggaguucaagaagaccaaggaggccaucagaagauuccugcuggccuacaagaugaugcuggaguucuucggcaucaagcugaccgacaagaccggcaacguggccagagccgugaacuggcaggagagauuccagcaccugaacgagagccagcacaacuaccugagaaucaccagaauccugaagagccugggcgagcugggcuacgagagcuucaagagcccccuggugaaguucauccugcacgaggcccugguggagaacaccauccccaacaucaagcagagcgcccuggaguacuucguguacaccaucagagacagaagagagagaagaaagcugcugagauucgcccagaagcacuacacccccagcgagaacuucaucuggggcccccccagaaaggagcagagcgagggcagcaaggcccagaagaugagcagcccccuggccagcagccacaacagccagaccagcaugcacaagaaggccaaggacagcaagaacagcagcagcgccgugcaccugaacagcaagaccgccgaggacaagaagguggcccccaaggagcccguggaggagaccgacagacccagccccgagcccagcaacgaggccgccaagcccagaaacaccgagaaggacagcaacgccgagaacaugaacagccagcccgagaagaccgugaccacccccaccgagaagaaggagagcgugagccccgagaacaacgaggagggcggcaacgacaaccaggacaacgagaaccccggcaacaccaacugccacgacguggugcuggugcagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2205 - RNA, 834 nt, Artificial Sequence
  mRNA product Design4 comprising derived and/or modified sequence from Homo sapiens__NP_008842.1__HsRLN1 (opt4)
gggagagucccgcagucggcguccagcggcucugcuuguucgugugugugucguugcaggccuuauucaagcuuaccaugcccagacuguuccuguuccaccugcuggaguucugccugcugcugaaccaguucagcagagccguggccgccaaguggaaggacgacgugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaucaucaugcuggaguucaucgccaaccugccccccgagcugaaggccgcccugagcgagagacagcccagccugcccgagcugcagcaguacgugcccgcccugaaggacagcaaccugagcuucgaggaguucaagaagcugaucagaaacagacagagcgaggccgccgacagcaaccccagcgagcugaaguaccugggccuggacacccacagccagaagaagagaagacccuacguggcccuguucgagaagugcugccugaucggcugcaccaagagaagccuggccaaguacugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2206 - RNA, 834 nt, Artificial Sequence
  mRNA product Design4 comprising derived and/or modified sequence from Homo sapiens__NP_604390.1__HsRLN2 (opt4)
gggagagucccgcagucggcguccagcggcucugcuuguucgugugugugucguugcaggccuuauucaagcuuaccaugcccagacuguucuucuuccaccugcugggcgugugccugcugcugaaccaguucagcagagccguggccgacagcuggauggaggaggugaucaagcugugcggcagagagcuggugagagcccagaucgccaucugcggcaugagcaccuggagcaagagaagccugagccaggaggacgccccccagacccccagacccguggccgagaucgugcccagcuucaucaacaaggacaccgagaccaucaacaugaugagcgaguucguggccaaccugccccaggagcugaagcugacccugagcgagaugcagcccgcccugccccagcugcagcagcacgugcccgugcugaaggacagcagccugcuguucgaggaguucaagaagcugaucagaaacagacagagcgaggccgccgacagcagccccagcgagcugaaguaccugggccuggacacccacagcagaaagaagagacagcuguacagcgcccuggccaacaagugcugccacgugggcugcaccaagagaagccuggccagauucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2207 - RNA, 705 nt, Artificial Sequence
  mRNA product Design4 comprising derived and/or modified sequence from Homo sapiens__NP_543140.1__HsRLN3  (opt4)
gggagagucccgcagucggcguccagcggcucugcuuguucgugugugugucguugcaggccuuauucaagcuuaccauggccagauacaugcugcugcugcugcuggccgugugggugcugaccggcgagcuguggcccggcgccgaggccagagccgcccccuacggcgugagacugugcggcagagaguucaucagagccgugaucuucaccugcggcggcagcagauggagaagaagcgacauccuggcccacgaggccaugggcgacaccuuccccgacgccgacgccgacgaggacagccuggccggcgagcuggacgaggccaugggcagcagcgaguggcuggcccugaccaagagcccccaggccuucuacagaggcagacccagcuggcagggcacccccggcgugcugagaggcagcagagacgugcuggccggccugagcagcagcugcugcaaguggggcugcagcaagagcgagaucagcagccugugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2208 - RNA, 1686 nt, Artificial Sequence
  mRNA product Design4 comprising derived and/or modified sequence from Homo sapiens__NP_002412.1__HsMMP1 (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2209 - RNA, 1446 nt, Artificial Sequence
  mRNA product Design4 comprising derived and/or modified sequence from Homo sapiens__NP_002412.1__HsMMP1(1-19,100-469) (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2210 - RNA, 3633 nt, Artificial Sequence
  mRNA product Design4 comprising derived and/or modified sequence from Clostridium histolyticum__BAA77453.1__ColG (opt4)
gggagagucccgcagucggcguccagcggcucugcuuguucgugugugugucguugcaggccuuauucaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2211 - RNA, 3357 nt, Artificial Sequence
  mRNA product Design4 comprising derived and/or modified sequence from Clostridium histolyticum__BAA77453.1__HsALB(1-18)_ColG(111-1118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2212 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2213 - RNA, 3381 nt, Artificial Sequence
  mRNA product Design4 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2214 - RNA, 3342 nt, Artificial Sequence
  mRNA product Design4 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2215 - RNA, 3276 nt, Artificial Sequence
  mRNA product Design4 comprising derived and/or modified sequence from Clostridium histolyticum__BAA34542.1__HsALB(1-18)_ColH(41-1021) (opt4)
gggagagucccgcagucggcguccagcggcucugcuuguucgugugugugucguugcaggccuuauucaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2216 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2217 - RNA, 1122 nt, Artificial Sequence
  mRNA product Design4 comprising derived and/or modified sequence from Homo sapiens__NP_003801.1__HsTNFSF10 (opt5)
gggagagucccgcagucggcguccagcggcucugcuuguucgugugugugucguugcaggccuuauucaagcuuaccauggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaaugauucuccgcacauccgaagagaccaucucuacaguccaggagaagcaacagaauauuagcccccuggugagagaacgggggccucagcgcguugcggcucacaucaccggaacaagaggccgguccaacacccugagcucucccaauuccaagaacgagaaagcccucgggcgcaagaucaauagcugggaaucuuccagaagcggacauucuuuucuguccaaccuucaucugcggaauggcgagcucgugauucacgagaaaggcuucuacuauaucuacagccagacguauuuucgcuuccaagaagagauuaaggaaaacaccaaaaaugauaagcagaugguccaguacaucuacaaguauacauccuacccugaccccauucugcuuaugaaaucugccagaaacagcugcugguccaaggaugcugaguaugggcuguacagcaucuaucaaggaggcauuuuugaacucaaagagaaugaccggaucuucgugucugugaccaacgagcaccugaucgauauggaccaugaagccuccuuuuucggggcuuuucuggucggaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2218 - RNA, 843 nt, Artificial Sequence
  mRNA product Design4 comprising derived and/or modified sequence from Homo sapiens__NP_003801.1__HsTNFSF10(95-281) (opt5)
gggagagucccgcagucggcguccagcggcucugcuuguucgugugugugucguugcaggccuuauucaagcuuaccaugaccagcgaggaaacaaucuccacggugcaggagaagcaacagaacauuucuccccuggucagagaacggggcccucagcgcguugccgcucacaucaccgggacaagaggacggagcaauacccucuccucuccgaacagcaaaaaugagaaggcccugggccgcaaaauuaacuccugggaaucuagcagauccgggcauagcuuccuuucuaaucugcaccuccggaacggagagcuggugauccaugagaagggcuuuuacuauauuuacucccagacauauuuccgcuuucaagaagagaucaaagaaaauaccaagaacgacaagcagauggugcaguacaucuauaaauacacaagcuaucccgauccuauucuucugaugaagucugcgagaaauuccugcuggagcaaagacgcugaguacgggcucuacucuaucuaucagggaggcauuuucgagcugaaggaaaacgaucggaucuuugucuccgugaccaaugagcaccugauugacauggaucaugaagccagcuucuuuggcgccuuccucguugggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2219 - RNA, 894 nt, Artificial Sequence
  mRNA product Design4 comprising derived and/or modified sequence from Homo sapiens__NP_003801.1__HsALB(1-18)_HsTNFSF10(95-281) (opt5)
gggagagucccgcagucggcguccagcggcucugcuuguucgugugugugucguugcaggccuuauucaagcuuaccaugaagugggugaccuucaucagccugcucuuucuguucuccucugccuacagcacauccgaggaaacgauuucuaccguccaggagaaacaacagaacaucagcccccuuguuagagaacggggcccucagcgcguggcugcccacauuacagggaccagaggacgguccaauacacugucuagcccgaacuccaagaaugagaaagcgcucggccgcaagaucaacagcugggaaucuuccagaagcgggcauucuuuucuguccaaucuucaucugcggaacggagagcucgugauucacgagaaaggcuucuauuacaucuauagccagaccuacuuucgcuuccaagaagagaucaaggaaaauacaaagaacgacaaacagaugguccaguauauuuacaaguauaccucuuaccccgauccuauccugcugaugaaauccgcuagaaauagcugcugguccaaggacgccgaguacgggcucuauucuauuuaccagggaggcaucuuugagcugaaagaaaacgaucggauuuucgugagcguuacgaaugagcaccuuaucgacauggaucaugaagccuccuuuuucggcgcuuuucugguggggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2220 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt5)
gggagagucccgcagucggcguccagcggcucugcuuguucgugugugugucguugcaggccuuauucaagcuuaccaugaagugggugaccuucaucagccugcucuuucuguucuccucugccuacagcagaaugaaacagauugaggacaagaucgaagagauucuuuccaaaaucuaucacauugaaaacgagaucgcucggaucaagaaacugauuggcgaaacaucugaggagacgaucagcaccguccaagaaaagcagcagaauauuucuccccucguucgcgagagagggccucagcggguggccgcgcauaucacaggaacccgcggcagauccaacacacugagcuccccgaauagcaagaacgaaaaagcucuugggcggaagauuaauucuugggaguccagccgcucuggacacuccuuucugagcaaccuccaucugagaaauggcgagcuggugauccacgaaaaaggguucuacuauauuuacucucaaaccuauuuucgguuccaggaggaaaucaaggagaacaccaaaaaugauaagcagaugguccaguacaucuauaaguacacauccuaccccgacccuauucuccugaugaaaagcgcccgcaacuccugcuggucuaaggaugccgaauauggacuuuacagcaucuaucaaggcggcauuuuugagcugaaagagaaugacagaaucuucguguccguuacgaacgaacaucucauugauauggaccacgaggcuagcuuuuucggggccuuucuggugggaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2221 - RNA, 1353 nt, Artificial Sequence
  mRNA product Design4 comprising derived and/or modified sequence from Rattus norvegicus__NP_036656.1__RnCebpa (opt5)
gggagagucccgcagucggcguccagcggcucugcuuguucgugugugugucguugcaggccuuauucaagcuuaccauggagagcgccgacuucuacgaagcugagcccagaccuccgauguccucucaucugcagagcccuccccacgcccccuccaacgcggcuuuuggcuucccucgcggggccggacccgccccuccgcccgcuccucccgccgcuccugaaccccucggcgggaucugcgagcacgaaaccucuauugauaucagcgccuauauugacccggcggccuuuaaugaugaguuccuggcugaccuuuuucaacauucccggcagcaggagaaggccaaagcugccgcgggaccugccggcgggggaggcgauuucgacuaccccggcgcuccugccgggcccggaggcgcugugaugucugccggggcccacggacccccuccgggcuaugggugugcugcggccggauaccuggauggcagacucgaaccccuguaugagcgggucggcgcuccugcccuucgcccccugguuaucaagcaggaaccuagagaggaggacgaagccaaacaacucgcucuggccgggcuguuucccuaccagccgccucccccucccccucccccgcauccucacgcgagccccgcucaccucgccgcuccccaucugcaguuccagauugcccacugcggacaaacaacgaugcaucuucagccuggccacccgacacccccucccaccccugugcccuccccucaccccgccccggcuaugggggccgcgggacugccuggccccgggggaagccucaagggccuggccggcccucaucccgaucuucggaccgggggaggcgggggaggcggggcuggcgccggaaaagcuaagaagucuguggacaaaaacuccaaugaguaucgcgucagacgggaacgcaacaauaucgccgugagaaagagccgggauaaagcgaagcagcgcaacguugagacacagcaaaaagugcuggaacucaccucugacaaugauagacugcggaagcgcgucgagcagcuguccagagagcucgacacacugcggggcaucuuuagacagcuuccggaaagcucucuggugaaggccauggggaacugugcuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2222 - RNA, 1311 nt, Artificial Sequence
  mRNA product Design4 comprising derived and/or modified sequence from Rattus norvegicus__NP_036656.1__RnCebpa(15-344) (opt5)
gggagagucccgcagucggcguccagcggcucugcuuguucgugugugugucguugcaggccuuauucaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacccugcccccgcuaugggggccgcuggacugccuggccccgggggaucccucaagggccuggccggcccgcauccugaccuuagaaccgggggaggcgggggaggcggggcgggcgccggaaaagcuaaaaagagcguggauaagaacucuaaugaguaccggguccgcagagagcggaacaauaucgccgugcgcaaguccagagacaaagcuaagcagcggaacguugaaacacagcaaaaagugcuggagcucaccagcgauaaugaccgccugagaaagcgggucgaacagcugucucgcgagcucgauacacugagaggcaucuuccggcagcuucccgaauccagccuggugaaggccauggggaacugugcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2223 - RNA, 1356 nt, Artificial Sequence
  mRNA product Design4 comprising derived and/or modified sequence from Mus musculus__NP_031704.2 __MmCebpa (opt5)
gggagagucccgcagucggcguccagcggcucugcuuguucgugugugugucguugcaggccuuauucaagcuuaccauggagagcgccgacuucuacgaaguggagcccagaccuccgauguccucucaucugcagagcccuccccacgcucccuccaacgccgcguuuggcuucccucgcggggcuggacccgccccuccgcccgccccucccgcugccccugaaccccucggcgggaucugcgagcacgaaaccucuauugauaucagcgcuuauauugacccggccgcguuuaaugaugaguuccuggccgaccuuuuucaacauucccggcagcaggagaaggcuaaagccgcugccggaccugcgggcgggggaggcgauuucgacuaccccggcgccccugcugggcccggaggcgccgucaugucugcuggggcccacggacccccuccgggcuaugggugugccgcugcgggauaccuggauggcagacucgaaccccuguaugagcggguuggcgccccugcccuucgcccccuggugaucaagcaggaaccuagagaggaggacgaagccaaacaacucgcccuggcugggcuguuucccuaccagccgccucccccucccccucccccgcauccucacgccagccccgcgcaccucgcugcuccccaucugcaguuccagauugcccacugcggacaaacaacgaugcaucuucagccuggccacccgacacccccucccaccccugugcccuccccucacgcugcccccgcucugggggccgcgggacucccgggcccugggagcgcccugaagggacuugcuggcgcccaucccgaucugcggaccggcgggggaggcgggggaucuggcgcuggggccggcaaagcgaagaaguccgucgacaaaaacagcaaugaguaucgcgugagacgggaacgcaacaauaucgccguuagaaagucucgggauaaagcuaagcagcgcaacguggagacacagcaaaaaguccucgaacugaccuccgacaaugauagacugcggaagcgcguggagcagcucagcagagagcuggacacacuucggggaaucuuuagacagcugccugaaucuucccucguuaaggccaugggcaacugugcuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2224 - RNA, 1314 nt, Artificial Sequence
  mRNA product Design4 comprising derived and/or modified sequence from Mus musculus__NP_031704.2 __MmCebpa(15-359) (opt5)
gggagagucccgcagucggcguccagcggcucugcuuguucgugugugugucguugcaggccuuauucaagcuuaccaugagcucccaucugcagucucccccucacgccccgagcaacgcugccuucggcuuucccagaggggcgggaccugcucccccucccgccccuccggccgcucccgagccucucggcgggaucugcgaacacgagaccuccauugacaucucugccuacauugaucccgcugccuucaaugacgaauuucuggcggaucuuuuccaacauagccggcagcaggagaaggccaaagcugccgcuggaccugccggcgggggaggcgacuuugauuaucccggcgcgccggccgggccuggaggcgcugugauguccgccggggcucacggacccccucccggcuacgggugugccgccgcuggauaucuggacggccgccucgaaccccuguacgagagagucggcgcgccugcccuucggccgcugguuaucaagcaggagccccgcgaagaggaugaagcuaaacaacucgcccuggccgggcuguucccuuaucagcccccucccccgccucccccuccccauccucacgcuucucccgcccaccucgcggcuccgcaucugcaguuucagauugcccacugcggacaaacaacgaugcaucuucagccuggccaccccacacccccuccgacccccgugccuagcccccacgccgcuccugcccugggggcugccggacuccccggcccuggguccgcgcugaagggacuugccggcgcucaucccgaccugagaaccggcgggggaggcgggggaagcggcgccggggcuggcaaagccaagaagucuguggauaaaaacuccaaugaguaccggguccgcagagagcggaacaauaucgcggugcgcaagagcagagacaaagccaagcagcggaacguugaaacacagcaaaaagugcucgagcugaccucugauaaugaccgccugagaaagcgggucgaacagcucucccgcgagcuggauacacuuagaggaaucuuccggcagcugccggaaagcucucucgugaaggcuaugggcaacugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2225 - RNA, 1353 nt, Artificial Sequence
  mRNA product Design4 comprising derived and/or modified sequence from Homo sapiens__NP_004355.2__HsCEBPA (opt5)
gggagagucccgcagucggcguccagcggcucugcuuguucgugugugugucguugcaggccuuauucaagcuuaccauggagagcgccgacuucuacgaagcugagcccagaccuccgauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2226 - RNA, 1311 nt, Artificial Sequence
  mRNA product Design4 comprising derived and/or modified sequence from Homo sapiens__NP_004355.2__HsCEBPA(15-358) (opt5)
gggagagucccgcagucggcguccagcggcucugcuuguucgugugugugucguugcaggccuuauucaagcuuaccauguccucucaucugcagagcccuccccacgcccccuccucugcggcuuuuggcuucccucgcggggccggacccgcccaaccuccggcucccccugccgcucccgaaccucucggcgggaucugcgagcacgaaaccagcauugauaucuccgccuauauugaccccgcggccuuuaacgaugaguuccuggcugaccuuuuucagcauucucggcagcaggagaaggccaaagcugccgugggaccgacaggcgggggaggcggcggggauuucgacuacccuggagcgcccgccggcccugggggagcugucaugcccggcggggcccacggacccccuccgggcuauggcugugcugccgccggguaccuggauggaagacucgaaccccuguaugagcggguuggcgcuccugcgcuucgcccccuggugaucaagcaagaaccuagagaggaggacgaagccaaacagcucgcucuggccgggcuguuucccuaccagccgccucccccucccccucccagccauccgcacccucaucccccucccgcccaccucgcugccccgcaucugcaguuccaaauugcgcacugcggacagacgaccaugcaccuucagcccggccacccuacacccccucccaccccugugcccuccccgcauccugcucccgcccugggggccgcuggacucccuggccccggcagcgcccugaaggggcuuggagcugcccacccggaucugcgggcgucuggcggguccggagccggcaaagcuaagaagucugucgacaaaaauagcaacgaguaucgcgugagacgggaacgcaauaacaucgccguuagaaagucccgggauaaagcuaagcagcgcaauguggagacacaacagaaaguccucgaacugaccagcgacaacgauagacugcggaagcgcguggagcagcucucuagagagcuggacacacuucgggggaucuuuagacaacugccugaauccagccucguuaaggccaugggcaauugugcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2227 - RNA, 1701 nt, Artificial Sequence
  mRNA product Design4 comprising derived and/or modified sequence from Homo sapiens__NP_000448.3__HsHNF4A (opt5)
gggagagucccgcagucggcguccagcggcucugcuuguucgugugugugucguugcaggccuuauucaagcuuaccaugagacugagcaagacccucguggacauggauauggccgacuacuccgcugcccuggaucccgcguauacaacgcuugaguucgaaaacguccagguucugaccaugggcaaugacacaucuccuagcgaggggaccaaccucaaugcuccgaacucccugggagugucugcccuuugcgccaucuguggcgaucgggcuacagggaaacacuacggagccagcuccugcgacggcuguaagggguuuuuccgcagaucugugcggaaaaaucauauguauagcugccgcuuuuccagacaaugugucguggauaaggacaaacggaaccagugccgcuacuguagacugaagaagugcuuccgggcuggaaugaaaaaggaagccguucagaaugagcgcgauagaauuagcacccggcgcagcuccuaugaagacagcucucuccccuccaucaacgcgcugcugcaggccgaggugcucagcagacaaauuacaucuccugucuccggcaucaauggcgauauucgggcuaaaaagaucgccagcaucgcugacgugugugaguccaugaaagaacagcugcuuguucugguggagugggccaaguacauucccgcguuuugcgaacucccucuggaugaccaggucgcccuucugcgcgcucacgccggggagcaucuccugcugggagcuaccaagagaucuaugguguucaaagacgugcuccugcuuggcaacgauuauaucgucccccggcacuguccugagcuggccgaaaugagcagaguuuccauucgcauccucgacgagcuggugcuuccguuucaggaacugcaaauugaugacaaugaguacgccuaccucaaggcuaucauuuucuuugaucccgacgcgaaagggcugagcgauccuggaaagaucaaacggcugagaucucaggugcaggucucccucgaagacuauaucaacgaucgccaguacgacagccggggcagauucggggagcugcuucugcuccugcccacgcuucaaucuauuaccuggcagaugaucgagcagauucaauuuaucaagcuguucggaauggccaaaauugauaaucuccugcaggaaaugcugcucggcggcagcccuuccgacgcuccccaugcccaccacccgcugcauccucaccuuaugcaggagcauauggggacaaacgugaucguugccaauaccaugcccacacaccugucuaacggacagaugugcgaauggccucgcccccggggccaagcugccacccccgagacgccucagccgucucccccugggggauccggcagcgaacccuauaagcuccugccuggggcgguggcuacaaucgucaagccccugucugccauuccgcagccuaccaucacaaaacaggaggugauuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2228 - RNA, 906 nt, Artificial Sequence
  mRNA product Design4 comprising derived and/or modified sequence from Homo sapiens__NP_061986.1__HsFGF21 (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2229 - RNA, 1632 nt, Artificial Sequence
  mRNA product Design4 comprising derived and/or modified sequence from Homo sapiens__NP_078852.3__HsOGFRL1 (opt5)
gggagagucccgcagucggcguccagcggcucugcuuguucgugugugugucguugcaggccuuauucaagcuuaccaugggcaaccugcucgggggagugagcuucagagagcccaccacagucgaagacugcgauuccacguggcagaccgacucugagccugaaccggaggaacccggcccugggggaggcagcgaggggcccggacaagaguccgaacagccugcccagcccccugagcaggcuggcggccggccgggggccucucccgcgccugaugaagacgcugaggccgccggagcugagcaaggcggggauagcacagaagccaccgcuaagcccaaacgcuccuuuuacgccgcgagagaccuguauaaguaccggcaccaguauccuaauuucaaagauauccgcuaccagaacgaccuuucuaaucugagauuuuauaagaacaaaauucccuucaagccggauggaguuuacaucgaggaagugcucagcaaguggaaaggcgacuaugagaagcuggaacauaaucacacauacauucaguggcuuuuuccucugcgggagcaagggcucaacuucuacgccaaagagcugaccacauaugaaaucgaggaauuuaagaaaaccaaggaggcuauucgcagauuccugcucgccuacaagaugaugcuggaauuuuucggaaucaaacuuacggauaagaccggcaauguggcucgggccgucaacuggcaggagcgcuuucagcaucugaaugagucccagcacaacuaucucagaaucacacggauucugaaaagccuuggcgaacugggguacgagucuuucaagucuccccucgugaaauuuauccugcaugaagcgcugguugagaauaccauuccuaacaucaagcaaagcgcccucgaauauuucguguacacaauucgcgacagacgggagcgcagaaaacugcuucgguucgcucagaagcacuauacccccucugagaauuuuaucuggggacccccuagaaaggaacaguccgagggcagcaaagcccaaaagaugucuuccccgcuggcuagcucccacaacucucagacgagcaugcauaaaaaggccaaagauuccaagaauagcuccuccgccguccaccucaacagcaagacagcugaagacaaaaagguggcgcccaaagagccuguugaggaaaccgaccgccccucuccugagcccagcaacgaagccgcuaagccgcggaauacagagaaagauuccaacgccgaaaauaugaacucucagccugagaagaccgugaccacacccacggagaagaaagaaagcgucuccccugagaauaacgaagaagggggaaaugacaaccaggauaaugagaaccccggcaauaccaacugucaugacguggugcugguccaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2230 - RNA, 834 nt, Artificial Sequence
  mRNA product Design4 comprising derived and/or modified sequence from Homo sapiens__NP_008842.1__HsRLN1 (opt5)
gggagagucccgcagucggcguccagcggcucugcuuguucgugugugugucguugcaggccuuauucaagcuuaccaugcccagacuguuccucuuucaccuucuugaguucugccugcuccugaaccaguuuagccgggccguggcugccaaguggaaagacgaugucaucaagcuguguggccgcgaacugguuagagcgcaaauugcuaucugcgggauguccaccuggucuaaacggagccucucccaggaggacgccccucagacaccgcgccccguggccgaaauugugccuucuuucaucaauaaggauacggagaccauuaucaucaugcuggaauuuauugcuaaccugcccccugagcucaaagccgcucugagcgagagacagcccucccuuccugaacugcaacaguacgucccggcccucaaggacucuaaucugagcuucgaggaauuuaagaaacuuauccggaaccgccaguccgaggcggccgauagcaaucccucugagcugaaguaucucggacuggacacacauucccagaaaaagagacggccuuacguggcucuguucgaaaaauguugccucauuggcuguaccaagcgcagccuggccaaguauugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2231 - RNA, 834 nt, Artificial Sequence
  mRNA product Design4 comprising derived and/or modified sequence from Homo sapiens__NP_604390.1__HsRLN2 (opt5)
gggagagucccgcagucggcguccagcggcucugcuuguucgugugugugucguugcaggccuuauucaagcuuaccaugcccagacuguucuuuuuccaccuccugggcgugugccuucugcucaaccaguuuagccgggccgucgcugacuccuggauggaggaaguuaucaagcugugugggcgcgagcuugugagagcccaaauugcgaucugcggaaugucuaccuggagcaaacggucccugucucaggaagaugcuccucagacaccgcgccccguggccgagauugucccuagcuucaucaauaaggacacggaaaccauuaacaugauguccgaguuuguggccaaucucccccaggagcugaaacugacacucucugaaaugcaaccugcucugccccagcuucagcagcauguuccugugcugaaggauagcucccuccuguucgaggaauuuaaaaagcugaucagaaaccggcaaagcgaggccgcugacucuuccccgagcgagcuuaaguaccucggccuggauacccacucucgcaaaaagagacagcuguauuccgcccucgcgaauaaauguugccaugucggguguacaaagcggagccuggcccgcuucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2232 - RNA, 705 nt, Artificial Sequence
  mRNA product Design4 comprising derived and/or modified sequence from Homo sapiens__NP_543140.1__HsRLN3  (opt5)
gggagagucccgcagucggcguccagcggcucugcuuguucgugugugugucguugcaggccuuauucaagcuuaccauggccagauacaugcugcuccugcuucuggcuguguggguccucaccggcgagcuguggcccggggccgaagcgcgggcugccccuuauggaguucgccuuugcggcagagaguucauccgggccgugauuuuuacaugugggggaagccgcuggagacgguccgacauccuggcucacgaagccaugggcgauacguucccggacgcugaugccgacgaggauucucucgcgggggaacuggacgaggccaugggaagcuccgaguggcuggcucucaccaagucuccccaggccuuuuaccgcggcagaccuagcuggcaaggcacacccggggugcugcggggaucccgcgauguccuugcuggccugucuagcuccugcuguaaaugggggugcagcaagucugaaauuuccagccucuguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2233 - RNA, 1686 nt, Artificial Sequence
  mRNA product Design4 comprising derived and/or modified sequence from Homo sapiens__NP_002412.1__HsMMP1 (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2234 - RNA, 1446 nt, Artificial Sequence
  mRNA product Design4 comprising derived and/or modified sequence from Homo sapiens__NP_002412.1__HsMMP1(1-19,100-469) (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2235 - RNA, 3633 nt, Artificial Sequence
  mRNA product Design4 comprising derived and/or modified sequence from Clostridium histolyticum__BAA77453.1__ColG (opt5)
gggagagucccgcagucggcguccagcggcucugcuuguucgugugugugucguugcaggccuuauucaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2236 - RNA, 3357 nt, Artificial Sequence
  mRNA product Design4 comprising derived and/or modified sequence from Clostridium histolyticum__BAA77453.1__HsALB(1-18)_ColG(111-1118) (opt5)
gggagagucccgcagucggcguccagcggcucugcuuguucgugugugugucguugcaggccuuauucaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2237 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2238 - RNA, 3381 nt, Artificial Sequence
  mRNA product Design4 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2239 - RNA, 3342 nt, Artificial Sequence
  mRNA product Design4 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2240 - RNA, 3276 nt, Artificial Sequence
  mRNA product Design4 comprising derived and/or modified sequence from Clostridium histolyticum__BAA34542.1__HsALB(1-18)_ColH(41-1021) (opt5)
gggagagucccgcagucggcguccagcggcucugcuuguucgugugugugucguugcaggccuuauucaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2241 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2242 - RNA, 1122 nt, Artificial Sequence
  mRNA product Design4 comprising derived and/or modified sequence from Homo sapiens__NP_003801.1__HsTNFSF10 (opt6)
gggagagucccgcagucggcguccagcggcucugcuuguucgugugugugucguugcaggccuuauucaagcuuaccauggcaaugauggaaguacaaggaggaccaucacuaggacaaacaugcguacuaauaguaauauucacaguacuacuccaaucacuaugugucgcagucacauacguauacuucacaaacgaauuaaaacaaaugcaagauaaauacucaaaaucaggaauagcuugcuucuuaaaagaagacgacucauacugggaccccaacgacgaagaaucaaugaauagcccaugcuggcaaguaaaauggcaacuaagacaauuaguaagaaaaaugauacuaagaacaucagaagaaacaauaucaacaguacaagaaaaacaacaaaacauaucaccccuaguaagagaaagaggaccacaaagaguagcagcacacauaacaggaacaagaggaagaagcaacacacuaucaaguccaaacagcaaaaacgaaaaagcacucggaagaaaaauaaacucaugggaauccagcagaagcggacacucauucuuaucaaaccuacauuuacgaaauggagaauuaguaauacacgaaaaaggauucuacuacauauacucacaaaccuacuucagauuccaagaagaaauaaaagaaaacaccaaaaacgacaaacaaaugguacaauacauauacaaauacacaucauauccagacccaauacuauuaaugaaaucagcaagaaauagcugcuggucaaaagacgcagaauacggacuauacucaauauaccaaggcggaauauucgaauuaaaagaaaacgacagaauauucguaucaguaacaaacgaacaccuaauagacauggaccacgaagcaaguuucuucggugcauucuuaguaggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2243 - RNA, 843 nt, Artificial Sequence
  mRNA product Design4 comprising derived and/or modified sequence from Homo sapiens__NP_003801.1__HsTNFSF10(95-281) (opt6)
gggagagucccgcagucggcguccagcggcucugcuuguucgugugugugucguugcaggccuuauucaagcuuaccaugacaagcgaagaaacaauaagcacaguacaagaaaaacaacaaaacauaagcccccuaguaagagaaagaggaccacaacgaguagcagcacacauaacaggaacaagaggaagaucaaacacacuaagcucaccaaacaguaaaaacgaaaaagcauuaggaagaaaaauaaacucaugggaaucaagcagaagcggacacucauucuuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaaguuacccagacccaauacuacuaaugaaaucagcaagaaacagcugcuggucaaaagacgccgaauacggacuauacucaauauaccaaggaggaauauucgaacuaaaagaaaacgacagaauauucgucucaguaacaaacgaacacuuaauagacauggaccacgaagcaucauucuucggagcauuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2244 - RNA, 894 nt, Artificial Sequence
  mRNA product Design4 comprising derived and/or modified sequence from Homo sapiens__NP_003801.1__HsALB(1-18)_HsTNFSF10(95-281) (opt6)
gggagagucccgcagucggcguccagcggcucugcuuguucgugugugugucguugcaggccuuauucaagcuuaccaugaaauggguaacauucauauccuuacuauuccuauucucaucagcauacucaacaucagaagaaacaauaucaacaguacaagaaaaacaacaaaacauauccccacuuguaagagaacgaggaccacaaagaguagcagcacacauaacaggaacaagaggaagauccaacacacuaucauccccaaacucaaaaaacgaaaaagcacuaggaagaaaaauaaacucaugggaaucauccagaucaggacacagcuuccuaucaaacuuacacuuaagaaacggagaacuuguaauacacgaaaaaggauucuacuacauauacucacaaacauacuucagauuccaagaagaaauaaaagaaaacacaaaaaacgacaaacaaaugguacaauacauauacaaauauacaucauacccagacccaauacuacuaaugaaaucagcaagaaacucaugcuggucaaaagacgcagaauacggacuauacagcauauaccaaggaggaauauucgaacuaaaagaaaacgacagaauauucguaucaguaacaaacgaacacuuaauagacauggaccacgaagcauccuucuucggagccuuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2245 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt6)
gggagagucccgcagucggcguccagcggcucugcuuguucgugugugugucguugcaggccuuauucaagcuuaccaugaaauggguaacauucauaucacucuuauucuuauucucaagcgcauacucaagaaugaaacaaauagaagacaaaauagaagaaauauuaucaaaaauauaccauaucgaaaacgaaauagcaagaauaaaaaaauuaauaggagaaacaucagaagaaacaauaagcacgguacaagaaaaacaacaaaacauaagcccacuuguaagagaaagaggaccacaaagaguagcagcacacauaaccggaacaagaggcagaagcaauacacuaucaucaccaaauagcaaaaacgaaaaagcacuaggaagaaaaauaaacaguugggaaucaagcagaagcggacacucauuccuaagcaaccuacaccuaaggaacggagaauuaguaauacacgaaaaaggauuuuacuacauauacucacaaacauacuucagauuccaagaagaaauaaaagaaaacacaaaaaacgacaaacaaaugguacaauacauauacaaauacacaagcuauccagacccaauacuacuaaugaaaagugcaagaaauagcugcuggucaaaagacgccgaauacggacuauacagcauauaccaaggaggaauauucgaauuaaaagaaaacgaccgaauauuuguaaguguaacaaacgaacaccuaauagacauggaccacgaagcuagcuucuucggagcauuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2246 - RNA, 1353 nt, Artificial Sequence
  mRNA product Design4 comprising derived and/or modified sequence from Rattus norvegicus__NP_036656.1__RnCebpa (opt6)
gggagagucccgcagucggcguccagcggcucugcuuguucgugugugugucguugcaggccuuauucaagcuuaccauggaaucagcugacuuuuaugaagcagaaccaagaccaccaaugucuucacaucuacaaaguccuccacaugcaccaucuaaugcagcuuuuggauuuccaagaggagcaggaccugcaccaccaccagcaccuccagcagcucccgaaccccuaggagguauaugugaacaugaaacaaguauagauauaagugcauacauagauccagcagcauuuaacgacgaauuuuuagcugaccuauuucaacauuccagacaacaagaaaaagcaaaagcugcagccggaccagcaggaggaggaggugauuucgacuauccaggagcaccagcaggaccuggcggagcaguaaugucagcaggagcacauggaccaccaccuggauacggaugugcagcagcuggauauuuagacggaagauuagaaccauuauaugaaagaguaggagcaccagcauuacguccauuaguaauaaaacaagaaccaagagaagaagacgaagcaaaacaacuagcacuugcagguuuauuuccauaucaaccaccuccuccaccaccaccaccacacccacacgccucaccagcacauuuagcagcaccucaucuacaauuucaaauagcacauuguggacaaacgacuaugcaucuacaaccaggacauccaacaccaccaccaacaccaguuccaucaccucauccagcacccgcuaugggagcagcaggccuaccaggaccaggagguucgcuaaaaggacucgcaggaccccauccagauuuaagaacaggagguggaggaggaggaggagcaggagcuggaaaagcaaaaaaaucaguagauaaaaacucaaacgaauacagagucagaagagaaagaaauaauauagcuguaagaaaaucaagagacaaagcaaaacaaagaaauguagaaacacaacaaaaaguacuugaauuaacaucugacaaugauagauuaagaaaaagaguagaacaauuaucaagagaacuagacacacuaagaggaauauuuagacaacuaccagaaucaagcuuaguuaaagccauggguaauugugcuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2247 - RNA, 1311 nt, Artificial Sequence
  mRNA product Design4 comprising derived and/or modified sequence from Rattus norvegicus__NP_036656.1__RnCebpa(15-344) (opt6)
gggagagucccgcagucggcguccagcggcucugcuuguucgugugugugucguugcaggccuuauucaagcuuaccaugaguucacauuuacaaagccccccucaugcaccaucaaaugcagcauuuggauucccaagaggugcaggaccagcaccuccaccagcaccaccagcugcaccagaaccucuaggaggaauaugugaacaugaaacaucuauagauauaucagcauauauagauccugcagcauucaaugaugaauuuuuagcagauuuauuucaacacucaagacaacaagaaaaagcaaaagcagcagcuggaccagcagguggaggaggagacuuugauuauccaggagcaccagcagguccuggcggagcaguaaugucagcaggagcacauggacccccuccuggauauggaugugcagcagcuggauauuuagacggaagauuagaaccauuauacgaaagaguaggagcaccugcauuaagaccauuaguaaucaaacaagaaccaagggaagaagaugaagcaaaacaauuagcauuagcuggauuauuuccauaucaaccaccaccaccaccaccaccaccacauccacaugcaucaccagcucauuuagcagcaccacaccuacaauuucaaauagcacauuguggacaaacuacuaugcauuuacaaccaggucauccaacaccaccaccaacaccaguaccaucaccacauccugcuccagcaaugggagcagcaggauuaccaggaccaggaggaucacuuaaagguuuagcaggaccacacccagaucuucgaacaggaggaggaggcggagguggugcaggagcaggaaaagccaaaaaaucaguugacaaaaauagcaaugaauacagaguaagacgagaaagaaauaauauagcaguaagaaaaagcagagauaaagcaaaacaaagaaauguagaaacacaacaaaaaguauuagaauuaacaucagacaaugaucguuuaagaaaacgaguagaacaacuuaguagagaauuagacacauuaagaggaauuuuuagacaauuaccagaaucaucauuaguaaaagcaaugggaaauugugcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2248 - RNA, 1356 nt, Artificial Sequence
  mRNA product Design4 comprising derived and/or modified sequence from Mus musculus__NP_031704.2 __MmCebpa (opt6)
gggagagucccgcagucggcguccagcggcucugcuuguucgugugugugucguugcaggccuuauucaagcuuaccauggaaucagcagauuuuuaugaaguagaaccacgaccaccuaugaguucucacuuacaaaguccaccacacgcaccaucaaaugcugcauuuggcuucccuagaggcgcaggaccagcaccaccuccugcaccaccagccgcaccagaaccauuaggaggaauuugugaacaugaaacaucuauagauauaucagcauauauagacccagcagcauucaaugaugaauuuuuagcagaucuauuccaacacaguagacaacaagaaaaagcuaaagcagcagcaggaccagcaggaggaggcggagacuuugauuauccuggagcaccugcaggaccuggaggugcaguaaugucagcaggugcacaugguccaccaccuggauauggaugugcugcagcaggauaccuagauggaagauuagaaccacuauaugaaagaguuggugcaccugccuuaagaccauuagucauuaaacaagaaccaagagaagaagaugaagcaaaacaauuagcacuagcaggauuauucccauaucaaccaccacccccccccccaccaccacauccacaugcaucaccagcacauuuagcagcuccacauuuacaauuucaaauagcacauuguggccaaacaacuaugcauuugcaaccaggacauccaacaccaccaccaacaccagucccaucuccucacgcugcaccagcacuuggugcagcaggauuaccaggaccaggaagugcacuuaaaggauuggcaggagcccaucccgauuuaagaacaggaggagguggaggaggaaguggagcaggugcaggaaaagcaaaaaaaaguguagauaaaaauagcaacgaauauagaguacgaagagaaagaaauaauauagcaguaagaaaaucaagagauaaagcaaaacaaaggaauguugaaacacaacaaaaaguauuagaauuaacauccgauaaugacagauuacgaaaaagaguagaacaacucucaagagaauuagauacacuaagagguauauuuagacaauuaccagaaucaucauuaguuaaagcaaugggaaauugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2249 - RNA, 1314 nt, Artificial Sequence
  mRNA product Design4 comprising derived and/or modified sequence from Mus musculus__NP_031704.2 __MmCebpa(15-359) (opt6)
gggagagucccgcagucggcguccagcggcucugcuuguucgugugugugucguugcaggccuuauucaagcuuaccaugucuagccauuuacaaucaccaccacaugcaccaucaaaugcugcauuuggcuuucccagaggagcagguccugcaccacccccagcuccuccagccgcuccugaaccauuaggaggaauaugugaacaugaaacaucaauagacauuucagcauauauagacccagcagcauuuaaugaugaauuucuagcagauuuauuucaacacagcagacaacaagaaaaagccaaagcagcagcaggaccagcaggaggugguggagauuuugauuacccaggcgcaccagcaggucccggaggugcaguuaugucagccggagcucauggaccaccaccuggcuacggcugugcagcagcaggauauuuagacgguagacuagaaccauuauacgaaagaguaggagccccagcacuaagaccauuaguaauaaaacaagaaccaagagaagaagaugaagcaaaacaauuagcauuagcuggauuauuuccauaucaaccaccaccuccaccuccaccaccacauccccaugcuucaccagcacaucuugcagcaccacauuuacaauuucaaauagcucauuguggacaaacaacaaugcaccuacaaccaggacacccaacaccaccaccuacuccaguaccauccccacaugcugcaccagcacuaggagcagcuggccuuccaggcccaggaucugcacuuaaaggauuagcaggagcucauccggauuuaagaacaggaggaggaggaggaggaucaggagcaggagcagguaaagcuaaaaaaucaguagauaaaaauucaaacgaauacagaguaagacgagaacgaaauaacauagccguaagaaaaucaagagauaaagcaaaacaaagaaacguagaaacacaacaaaaaguauuagaacuaacaagugauaaugaucgacuaagaaaaagaguagaacaacuaucaagagaauuagauacacuucguggaauauuuagacaauuaccagaaucaucauuaguuaaagcaaugggaaauugugcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2250 - RNA, 1353 nt, Artificial Sequence
  mRNA product Design4 comprising derived and/or modified sequence from Homo sapiens__NP_004355.2__HsCEBPA (opt6)
gggagagucccgcagucggcguccagcggcucugcuuguucgugugugugucguugcaggccuuauucaagcuuaccauggaaucagcagauuuuuacgaagcagaaccaagacccccaaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2251 - RNA, 1311 nt, Artificial Sequence
  mRNA product Design4 comprising derived and/or modified sequence from Homo sapiens__NP_004355.2__HsCEBPA(15-358) (opt6)
gggagagucccgcagucggcguccagcggcucugcuuguucgugugugugucguugcaggccuuauucaagcuuaccaugucaucacaucuacaaucuccuccacaugcaccuucaagugcugcauucgguuuuccaagaggagcaggaccagcacaaccaccagcucccccagcugcaccagaacccuuagguggaauaugcgaacaugaaacaucuauagauauuucagcauauauagauccagcagcauuuaaugaugaauuuuuagcagaccuauuucaacauagcagacaacaagaaaaagcuaaagcagcaguaggaccuacaggaggaggagguggaggagauuuugauuauccaggugcaccagcaggcccaggaggagcaguuaugccaggaggagcacauggaccaccaccaggauauggcugcgcagcagcagguuaccucgauggacgauuagaaccauuauaugaaagaguaggagcuccugcauuaagaccuuuagucauaaaacaagaaccacgagaagaagacgaagcaaaacaacuagcauuagcagguuuauuuccauaucaaccaccaccaccaccaccaccaucacacccccauccacacccaccuccagcacacuuagcagcaccacaucuacaauuucaaauagcucacuguggacaaacaacaaugcaucuacaaccaggacauccaacaccaccuccuacaccuguaccuuccccacauccugcaccagcacuaggagcagcaggauuaccaggaccugguagugcauuaaaaggacuaggcgcagcucacccagacuuacgagcaucuggaggaucaggugcaggaaaagcaaaaaaaucaguagauaaaaacucaaaugaauauagaguccgacgugaaagaaauaauauagcaguaagaaaaucuagagacaaagcaaaacaaagaaauguagaaacacaacaaaaaguauuagaacuuacaucagauaaugauagacuaagaaaaagagucgaacaauuaucaagagaauuagacacauuacguggaaucuuuagacaacuaccagaaucaucacuuguuaaagcaaugggaaauugugccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2252 - RNA, 1701 nt, Artificial Sequence
  mRNA product Design4 comprising derived and/or modified sequence from Homo sapiens__NP_000448.3__HsHNF4A (opt6)
gggagagucccgcagucggcguccagcggcucugcuuguucgugugugugucguugcaggccuuauucaagcuuaccaugcgauuaucaaaaacacucguagauauggauauggcggacuacucagcagcauuagaccccgcauauaccacauuagaauuugaaaacguccaaguauuaacaaugggaaaugacacaucucccucagaaggaacaaaccucaacgcaccaaacucucuaggaguaucagcucuaugcgccauaugcggagaccgagccacaggaaaacacuacggagcaucaucaugugacgguugcaaaggauucuucagaagaucuguaagaaaaaaucacauguacucaugcagauucucuagacaaugcguugucgacaaagacaaaagaaaucaaugcagauacugcagacugaaaaaaugcuucagagcaggaaugaaaaaagaagcaguacaaaacgaaagagauagaauuuccacacguagaucuucauaugaagacuccucauuaccaucaauaaaugcacuauuacaagcagaaguacuaucacgacaaauaaccucccccguaucaggaauuaacggagauauaagagcaaaaaaaauagcaucaauagccgauguaugcgagagcaugaaagaacaacuauuaguacuuguagaaugggcaaaauacaucccagcuuuuugcgaauuaccguuagaugaccaaguagcauuauuaagagcacacgcaggagaacaucuauuacucggugcaacaaaaagauccaugguauucaaagacguccuacuucuaggaaacgacuacauaguaccacgccacugccccgaauuagcagaaauguccagaguuaguauaagaauacuagacgaauuaguacuaccauuccaagaacuacaaauagaugacaacgaauaugcauauuuaaaagcaaucaucuucuucgauccagacgcaaaaggacuauccgauccugguaaaauaaaaagguuaagaucacaaguacaaguaucacuugaggauuacaucaacgauagacaauacgacucacgagguagguuuggagaacuauuacuuuuauuaccaaccuuacaaucaaucacauggcaaaugauagaacaaauacaauucaucaaacuauucggaauggccaaaauagacaaccuacuacaagaaauguuauuaggaggaucaccaucugacgcaccacacgcacaccauccacuacacccacaucuaaugcaagaacacauggguacaaacguaauagucgcaaauacaaugccaacacaccuaucuaacggacaaaugugcgaauggccacgcccacgaggacaagcagcaacaccugaaaccccacaaccaucaccacccggagguucaggaucagaaccauacaaacuccuaccuggagcaguagcaacaauaguaaagccauuaucagcaauaccacaaccaacaauaacaaaacaagaaguaauauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2253 - RNA, 906 nt, Artificial Sequence
  mRNA product Design4 comprising derived and/or modified sequence from Homo sapiens__NP_061986.1__HsFGF21 (opt6)
gggagagucccgcagucggcguccagcggcucugcuuguucgugugugugucguugcaggccuuauucaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2254 - RNA, 1632 nt, Artificial Sequence
  mRNA product Design4 comprising derived and/or modified sequence from Homo sapiens__NP_078852.3__HsOGFRL1 (opt6)
gggagagucccgcagucggcguccagcggcucugcuuguucgugugugugucguugcaggccuuauucaagcuuaccaugggaaauuuauuagguggaguauccuucagagaaccaacaacagucgaagacugugacagcacauggcaaacggacucagaaccagaaccagaagaaccaggaccaggaggaggaucagaaggaccaggucaagaaucagaacaaccagcacaaccaccagaacaagcaggaggaagaccaggugcauccccagccccagacgaagacgcagaagcagccggagcagaacaaggaggugacaguacagaagcuaccgcaaaacccaaacgaucauucuacgcagcaagagaccuuuacaaauacagacaccaguauccaaacuucaaagacauuagauaccaaaaugauuuaagcaaccuacgauuuuauaaaaauaaaauaccauucaaacccgacggagucuacauagaagaaguacuaucaaaauggaaaggcgauuacgaaaaauuagaacauaaccacacauacauacaaugguuauucccacucagagaacaaggauuaaauuuuuaugcaaaagaacuuacaacauacgaaauagaagaauuuaaaaaaacaaaagaagcaauacgcagauuccuacuggcauacaaaaugaugcuagaauuuuucggcauaaaauuaacagacaaaaccggcaacguagcaagagcaguaaacuggcaagaacgauuccaacaucuaaacgaaagccaacacaacuaccugagaauaacacgcauacuaaaaucacuaggagaacuaggcuaugaauccuuuaaaagcccauuaguaaaauucauacuacaugaagccuuaguagaaaacacaauaccaaacauaaaacaaucagcauuagaauacuucguauauacaauaagagacagaagagaaagaagaaagcuauuacgauuugcacaaaaacauuacacacccucagaaaacuucaucuggggcccaccaagaaaagaacaaucagaaggaucaaaagcacaaaaaaugagcucaccacuagcaaguucacauaacucacaaacauccaugcauaaaaaagcaaaagauucaaaaaauuccucaucagcaguacaccuaaacaguaaaacugccgaagacaaaaaaguagcaccaaaagaaccaguagaagaaacagacagacccucaccugaaccuagcaacgaagcagcaaaaccaagaaauacagaaaaagauucaaacgcagaaaauaugaacucacaaccagaaaaaacugucaccacaccaacagaaaaaaaagaaucaguaucaccagaaaauaacgaagaaggaggcaacgauaaccaagacaacgaaaacccagguaacacaaacugucacgacgucguauuaguucaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2255 - RNA, 834 nt, Artificial Sequence
  mRNA product Design4 comprising derived and/or modified sequence from Homo sapiens__NP_008842.1__HsRLN1 (opt6)
gggagagucccgcagucggcguccagcggcucugcuuguucgugugugugucguugcaggccuuauucaagcuuaccaugccaagacuauucuuauuccaccuauuagaauuuugccuacuacuaaaccaauuuuccagagcaguagcagcaaaauggaaagacgacguaauaaaauuaugcggaagagaacucguaagagcacaaauagcaauaugcggaaugucaacauggucaaaaagaucacuaucacaagaagacgcaccacaaacaccaagaccaguagcagaaauagucccaucauucauaaacaaagacacagaaacaauaauaauaaugcuagaauuuauagcaaacuuaccacccgaacuaaaagcagcacuaucagaaagacaaccaucacuaccagaacuacaacaauacgucccagcacuaaaagacucaaaccuauccuucgaagaauuuaaaaaacucauaagaaacagacaaucagaagcagcagacucaaacccauccgaacuaaaauaccuaggacuagacacacacucacaaaaaaaaagaagaccauacguagcccuauucgaaaaaugcugccuaauaggauguacaaaacgcucacuagcaaaauacugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2256 - RNA, 834 nt, Artificial Sequence
  mRNA product Design4 comprising derived and/or modified sequence from Homo sapiens__NP_604390.1__HsRLN2 (opt6)
gggagagucccgcagucggcguccagcggcucugcuuguucgugugugugucguugcaggccuuauucaagcuuaccaugccaagacuauucuucuuccaccuacuaggaguaugccuacuccuaaaccaauucuccagagcaguagcagacucauggauggaagaaguaauaaaacuaugcggaagagaacuuguaagagcacaaauagcaauaugcggaauguccacauggucaaaaagaucacuaucacaagaagacgcaccacaaacaccaagaccaguagcagaaauaguaccaucauucauaaacaaagauacagaaacaauaaacaugaugucagaauuugucgcaaaccuaccacaagaauuaaaacuaacauuaucagaaaugcaaccagcccuaccacaacuacaacaacacguacccguacuaaaagacucaucauuacuauucgaagaauuuaaaaaacuaauaagaaacagacaaucagaagcagcagacagcucaccaucagaauuaaaauaccucggacuagacacacacucaagaaaaaaaagacaauuauacucagcacuagcaaacaaaugcugccacguaggaugcacaaaaagaucacuagccagauucugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2257 - RNA, 705 nt, Artificial Sequence
  mRNA product Design4 comprising derived and/or modified sequence from Homo sapiens__NP_543140.1__HsRLN3  (opt6)
gggagagucccgcagucggcguccagcggcucugcuuguucgugugugugucguugcaggccuuauucaagcuuaccauggcaagauauauguuauuauuauuauuagcaguauggguacuaacaggagaauuauggccaggagcagaagcaagagcagcaccauauggaguaagauuguguggaagagaauuuauaagagcaguaauauuuacauguggaggaagcagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaggcauuuuauagaggaagaccaaguuggcaaggaacaccaggaguauuaagaggaagcagagauguauuagcaggauuaaguaguaguuguuguaaauggggauguaguaaaagugaaauaaguaguuuauguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2258 - RNA, 1686 nt, Artificial Sequence
  mRNA product Design4 comprising derived and/or modified sequence from Homo sapiens__NP_002412.1__HsMMP1 (opt6)
gggagagucccgcagucggcguccagcggcucugcuuguucgugugugugucguugcaggccuuauucaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2259 - RNA, 1446 nt, Artificial Sequence
  mRNA product Design4 comprising derived and/or modified sequence from Homo sapiens__NP_002412.1__HsMMP1(1-19,100-469) (opt6)
gggagagucccgcagucggcguccagcggcucugcuuguucgugugugugucguugcaggccuuauucaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2260 - RNA, 3633 nt, Artificial Sequence
  mRNA product Design4 comprising derived and/or modified sequence from Clostridium histolyticum__BAA77453.1__ColG (opt6)
gggagagucccgcagucggcguccagcggcucugcuuguucgugugugugucguugcaggccuuauucaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2261 - RNA, 3357 nt, Artificial Sequence
  mRNA product Design4 comprising derived and/or modified sequence from Clostridium histolyticum__BAA77453.1__HsALB(1-18)_ColG(111-1118) (opt6)
gggagagucccgcagucggcguccagcggcucugcuuguucgugugugugucguugcaggccuuauucaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2262 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt6)
gggagagucccgcagucggcguccagcggcucugcuuguucgugugugugucguugcaggccuuauucaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2263 - RNA, 3381 nt, Artificial Sequence
  mRNA product Design4 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2264 - RNA, 3342 nt, Artificial Sequence
  mRNA product Design4 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2265 - RNA, 3276 nt, Artificial Sequence
  mRNA product Design4 comprising derived and/or modified sequence from Clostridium histolyticum__BAA34542.1__HsALB(1-18)_ColH(41-1021) (opt6)
gggagagucccgcagucggcguccagcggcucugcuuguucgugugugugucguugcaggccuuauucaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2266 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt6)
gggagagucccgcagucggcguccagcggcucugcuuguucgugugugugucguugcaggccuuauucaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2267 - RNA, 1122 nt, Artificial Sequence
  mRNA product Design4 comprising derived and/or modified sequence from Homo sapiens__NP_003801.1__HsTNFSF10 (opt7)
gggagagucccgcagucggcguccagcggcucugcuuguucgugugugugucguugcaggccuuauucaagcuuaccauggccaugauggaggugcagggcgggcccagccugggucaaaccugcguccucaucgugauuuucacuguacuguugcagucccuguguguggcagucaccuacguguauuuuacgaacgaacucaagcagaugcaggacaaauacaguaagagcggcaucgccugcuuccugaaagaggaugacuccuauugggauccaaaugacgaagagaguaugaacagcccguguuggcaagugaaguggcaguugaggcagcugguccggaaaaugauucuccgcacuuccgaagagaccaucagcaccgugcaggagaagcaacagaauauuaguccccugguaagggaacgggggccacagcgcguggcggcccacaucacuggcaccaggggucgguccaacacgcugagcucccccaauagcaagaacgagaaagcacucgggcgcaagaucaauaguugggaauccagcagguccggccauaguuuucugagcaacuugcaucugcggaauggcgagcucgucauucacgagaaaggguucuacuauaucuacucccagacuuauuuucgcuuccaagaagagauuaaggaaaacaccaaaaaugauaagcagauggugcaguacaucuacaaauauacuagcuacccagaccccauucugcugaugaagagugccaggaacuccugcuggagcaaggaugcagaguaugguuuguacaguaucuaucaaggcgggauuuuugaacucaaagagaaugaccggaucuucguguccgucaccaacgagcaccugaucgauauggaccaugaagccagcuuuuucggcgcguuucugguggguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2268 - RNA, 843 nt, Artificial Sequence
  mRNA product Design4 comprising derived and/or modified sequence from Homo sapiens__NP_003801.1__HsTNFSF10(95-281) (opt7)
gggagagucccgcagucggcguccagcggcucugcuuguucgugugugugucguugcaggccuuauucaagcuuaccaugaccagcgaggaaacuaucuccaccgugcaggagaagcaacagaacauuaguccccuggucagggaacggggcccacagcgcguggccgcacacaucacggggacuaggggucggagcaauacccucuccaguccgaacagcaaaaaugagaaggcccugggccgcaaaauuaacuccugggaaagcuccaggagugggcauagcuucuuguccaaucugcaccuccggaacggcgagcugguaauccaugagaaggguuuuuacuauauuuacagccagaccuauuuccgcuuucaagaagagaucaaagaaaauacuaagaacgacaagcagauggugcaguacaucuauaaauacaccaguuaucccgauccaauuuugcugaugaaguccgcgaggaauagcugcugguccaaagacgccgaguacgggcucuacaguaucuaucagggcggcauuuucgagcugaaggaaaacgaucggaucuuugucagcgugacgaaugagcaccugauugacauggaucaugaagcauccuucuuuggggccuuccucguggguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2269 - RNA, 894 nt, Artificial Sequence
  mRNA product Design4 comprising derived and/or modified sequence from Homo sapiens__NP_003801.1__HsALB(1-18)_HsTNFSF10(95-281) (opt7)
gggagagucccgcagucggcguccagcggcucugcuuguucgugugugugucguugcaggccuuauucaagcuuaccaugaagugggugaccuucaucagccugcucuuucuguucuccagugccuacagcacuuccgaggaaaccauuaguacgguccaggagaaacaacagaacaucagccccuuggugagggaacggggcccacagcgcguagcagcccacauuacugggaccaggggucgguccaauacccugagcuccccgaacaguaagaaugagaaagcgcucggccgcaagaucaacagcugggaauccagcaggagugggcauuccuuucugagcaauuugcaucugcggaacggcgagcucgugauucacgagaaagguuucuauuacaucuauucccagacuuacuuucgcuuccaagaagagaucaaggaaaauaccaagaacgacaaacagaugguccaguauauuuacaaguauacgaguuaccccgauccaauccugcugaugaaaagcgccaggaacuccugcuggagcaaggacgcagaguacgggcucuauaguauuuaccagggcggcaucuuugagcugaaagaaaaugaucggauuuucguguccgugacuaaugagcacuugaucgacauggaucaugaagccagcuuuuucggggcauuucuggucgguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2270 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt7)
gggagagucccgcagucggcguccagcggcucugcuuguucgugugugugucguugcaggccuuauucaagcuuaccaugaagugggugaccuucaucagccugcucuuucuguucuccagugccuacagcaggaugaaacagauugaggacaagaucgaagagauuuuguccaaaaucuaucacauugaaaacgagaucgcacggaucaagaaacugauuggcgaaaccagugaggagacuaucagcacgguccaagaaaagcagcagaauauuaguccccucgugcgcgagagggggccacagcggguagccgcgcauaucacugguacccgcggcaggagcaacacccuguccaguccgaauagcaagaacgaaaaagccuuggggcggaagauuaauuccugggagagcagucgcuccggccacagcuuucuguccaaccuccaucugaggaauggugagcuggugauccacgaaaaaggguucuacuauauuuacagucaaacuuauuuucgguuccaggaggaaaucaaggagaacaccaaaaaugauaagcagaugguccaguacaucuauaaauacacgagcuaccccgacccaauucuccugaugaaguccgcacgcaacagcugcuggaguaaggaugccgaauauggcuuguacuccaucuaucaaggcgggauuuuugagcugaaagagaaugacaggaucuucgugagcgugacuaacgaacaucucauugauauggaccacgaggcauccuuuuucggugccuuucuggucggcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2271 - RNA, 1353 nt, Artificial Sequence
  mRNA product Design4 comprising derived and/or modified sequence from Rattus norvegicus__NP_036656.1__RnCebpa (opt7)
gggagagucccgcagucggcguccagcggcucugcuuguucgugugugugucguugcaggccuuauucaagcuuaccauggagagcgccgacuucuacgaagcagagcccaggccaccgauguccagucaucugcagagcccaccccacgcccccuccaacgcggccuuuggcuucccccgcggggcaggucccgccccaccgcccgcaccacccgccgcgccagaaccccucggcgggaucugcgagcacgaaaccaguauugauaucagcgccuauauugacccggcagccuuuaaugaugaguuccuggccgacuuguuucaacauucccggcagcaggagaaggcaaaagccgcggccggccccgccggugggggcggcgauuucgacuacccaggggcccccgcagguccaggcggggccgugaugagcgccggcgcgcacggucccccaccgggguauggcugugcagccgccggcuaccuggaugggaggcucgaaccccuguaugagcgggucggugcaccagccuugcgcccccuggugaucaagcaggaaccaagggaggaggacgaagcgaaacaacucgcccuggcaggccuguuucccuaccagccgccaccacccccacccccaccgcauccccacgccuccccagcacaccucgccgcaccccaucugcaguuccagauugcacacugcgggcaaacuaccaugcauuugcagccaggccaccccacgccgccacccacuccaguacccaguccgcaccccgccccagcgaugggugccgcaggccugcccgggccaggcgggagccucaagggucuggccggcccccauccagaucugcggaccgggggcgguggcgggggcggggccggcgcagguaaagcgaagaaguccguggacaaaaacagcaaugaguaucgcgucaggcgggaacgcaacaauaucgccgugaggaagagucgggauaaagcaaagcagcgcaacguggagacccagcaaaaagucuuggaacucacuuccgacaaugauaggcugcggaagcgcguggagcagcugagcagggagcucgacacccugcgggggaucuuucgccaguugccggaauccagucugguaaaagccaugggcaacugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2272 - RNA, 1311 nt, Artificial Sequence
  mRNA product Design4 comprising derived and/or modified sequence from Rattus norvegicus__NP_036656.1__RnCebpa(15-344) (opt7)
gggagagucccgcagucggcguccagcggcucugcuuguucgugugugugucguugcaggccuuauucaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacccagcccccgcaaugggugccgcgggccugccggggcccggcgggagucucaagggucuggccggcccacaucccgaccugaggaccgggggcgguggcgggggcggggcaggcgccgguaaagccaaaaagagcguggauaagaacuccaaugaguaccggguccgcagggagcggaacaauaucgcagugcgcaagagcagggacaaagcgaagcagcggaacguggaaacccagcaaaaagucuuggagcucacuuccgauaaugaccgccugaggaagcggguggaacagcugucccgcgagcucgauacccugagggggaucuuccggcaguugccagaaagcucccugguaaaagccaugggcaacugugcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2273 - RNA, 1356 nt, Artificial Sequence
  mRNA product Design4 comprising derived and/or modified sequence from Mus musculus__NP_031704.2 __MmCebpa (opt7)
gggagagucccgcagucggcguccagcggcucugcuuguucgugugugugucguugcaggccuuauucaagcuuaccauggagagcgccgacuucuacgaaguggagcccaggccaccgauguccagucaucugcagagcccaccccacgcacccuccaacgccgcguuuggcuucccccgcggggccggucccgcaccaccgcccgccccacccgcagccccagaaccccucggcgggaucugcgagcacgaaaccaguauugauaucagcgcguauauugacccggccgcauuuaaugaugaguuccuggccgacuuguuucaacauucccggcagcaggagaaggccaaagcagccgcgggccccgccggugggggcggcgauuucgacuacccaggggcacccgccgguccaggcggggcagucaugagcgccggcgcccacggucccccaccgggguauggcugugcggcagccggcuaccuggaugggaggcucgaaccccuguaugagcgggugggugccccagcauugcgcccccugguaaucaagcaggaaccaagggaggaggacgaagccaaacaacucgcgcuggccggccuguuucccuaccagccgccaccacccccacccccaccgcauccccacgcauccccagcccaccucgcagcaccccaucugcaguuccagauugcccacugcgggcaaacuaccaugcauuugcagccaggccaccccacgccgccacccacuccagugcccaguccgcacgccgcccccgcgcugggugccgcaggccucccagggcccggcagcgcccugaaggggcuggccggugcacauccagauuugcggaccggcgggggcgguggcggguccggcgcgggggccggcaaagcaaagaaaagcgucgacaagaacaguaaugaguaucgcgugaggcgggaacgcaacaauaucgccgugaggaagucccgggauaaagccaagcagcgcaacgucgagacccagcaaaaagugcucgaacugacuagcgacaaugauaggcugcggaagcgcguagagcagcucuccagggagcuggacaccuugcgggguaucuuucgccagcugcccgaaaguagccucgugaaagcaauggggaacugugccugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2274 - RNA, 1314 nt, Artificial Sequence
  mRNA product Design4 comprising derived and/or modified sequence from Mus musculus__NP_031704.2 __MmCebpa(15-359) (opt7)
gggagagucccgcagucggcguccagcggcucugcuuguucgugugugugucguugcaggccuuauucaagcuuaccaugagcucccaucugcagagucccccacacgccccgagcaacgcagccuucggcuuucccaggggugcggggccagcacccccacccgccccaccggccgcacccgagccacucggcgggaucugcgaacacgagaccuccauugacaucagugccuacauugaucccgcggccuucaaugacgaauuucuggcagauuuguuccaacauagccggcagcaggagaaggccaaagccgcagccggcccagcgggugggggcggcgacuuugauuaucccggggccccggcaggucccggcggggccgugauguccgcaggcgcccacgguccacccccaggguacggcugugccgcggcaggcuaucuggacgggcgccucgaaccccuguacgagagggucggugccccagccuugcggccgcuggugaucaagcaggagccccgcgaagaggaugaagcaaaacaacucgcccuggcgggccuguucccauaucagcccccacccccgccacccccaccccauccccacgccagcccagcacaccucgccgcaccgcaucugcaguuucagauugcccacugcgggcaaacuaccaugcauuugcagcccggccacccaacgcccccacccacuccgguaccaaguccccacgccgcaccagcccugggugcggccggccuccccgggccgggcuccgcacugaaggggcuggccggugcccaucccgacuugaggaccggcgggggcgguggcgggagcggcgcaggggcgggcaaagccaagaaguccguggauaaaaacagcaaugaguaccggguccgcagggagcggaacaauaucgcagugcgcaagaguagggacaaagccaagcagcggaacguggaaacccagcaaaaaguccucgagcugacuuccgauaaugaccgccugaggaagcggguggaacagcucagccgcgagcuggauaccuugagggguaucuuccggcagcugccagaauccagucucguaaaagccauggggaacugugcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2275 - RNA, 1353 nt, Artificial Sequence
  mRNA product Design4 comprising derived and/or modified sequence from Homo sapiens__NP_004355.2__HsCEBPA (opt7)
gggagagucccgcagucggcguccagcggcucugcuuguucgugugugugucguugcaggccuuauucaagcuuaccauggagagcgccgacuucuacgaagcagagcccaggccaccgauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2276 - RNA, 1311 nt, Artificial Sequence
  mRNA product Design4 comprising derived and/or modified sequence from Homo sapiens__NP_004355.2__HsCEBPA(15-358) (opt7)
gggagagucccgcagucggcguccagcggcucugcuuguucgugugugugucguugcaggccuuauucaagcuuaccauguccagucaucugcagagcccaccccacgcccccuccagugcggccuuuggcuucccccgcggggcaggucccgcccaaccaccggcacccccagccgcgcccgaaccacucggcgggaucugcgagcacgaaaccagcauugauaucuccgccuauauugaccccgcagccuuuaacgaugaguuccuggccgacuuguuucagcauagccggcagcaggagaaggcaaaagccgcggugggcccgacuggugggggcggcgggggugauuucgacuaccccggcgccccagcagggcccggcggugccgucaugccagggggcgcacacgggcccccaccgggcuaugguugugccgccgcgggcuaccuggaugggaggcucgaaccccuguaugagcgggugggcgcaccagccuugcgcccccugguaaucaagcaagaaccaagggaggaggacgaagccaaacagcucgcacuggccggucuguuucccuaccagccgccaccacccccacccccaucccauccgcacccccacccacccccagcgcaucucgccgcaccccaucugcaguuccaaauugcccacugcggccagaccacgaugcacuugcagccggggcacccaacucccccacccaccccggugcccaguccacaucccgcaccagcccugggcgccgcagggcuccccgguccaggcagcgcccugaaggggcugggcgcggcccacccggauuugcgggcauccgguggcagcggggccggcaaagccaagaagagugucgacaaaaauuccaacgaguaucgcgugaggcgggaacgcaauaacaucgcagugaggaaaagccgggauaaggcgaagcagcgcaaugucgagacccaacagaaagugcucgaacugacuuccgacaacgauaggcugcggaagcgcguagagcagcucaguagggagcuggacaccuugcgggggaucuuucgccaacugcccgaaagcucccucgugaaagccaugggcaauugugcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2277 - RNA, 1701 nt, Artificial Sequence
  mRNA product Design4 comprising derived and/or modified sequence from Homo sapiens__NP_000448.3__HsHNF4A (opt7)
gggagagucccgcagucggcguccagcggcucugcuuguucgugugugugucguugcaggccuuauucaagcuuaccaugaggcugagcaagacccucguggacauggauauggccgacuacuccgcagcccuggaucccgcguauacuaccuuggaguucgaaaacguccaggugcugacgaugggcaaugacacuagcccaagcgaggggaccaaccucaaugccccgaacucccuggguguaagugcauugugcgccaucuguggcgaucgggcaaccgggaaacacuacggcgccagcuccugcgacgguuguaagggguuuuuccgcaggagcgugcggaaaaaucauauguauuccugccgcuuuaguaggcaaugugucguggauaaggacaaacggaaccagugccgcuacuguaggcugaagaagugcuuccgggcgggcaugaaaaaggaagccgugcagaaugagcgcgauaggauuagcacucggcgcuccagcuaugaagacaguucccuccccagcaucaacgcacugcugcaggccgagguccucuccaggcaaauuaccaguccagugagcggcaucaauggggauauucgggccaaaaagaucgcauccaucgccgacguaugugagagcaugaaagaacagcuguuggugcuggucgagugggcgaaguacauucccgccuuuugcgaacucccacuggaugaccagguggcacuguugcgcgcccacgccggugagcaucuccugcugggcgcaacgaaaaggaguaugguguucaaggacguccuccuguuggggaacgauuauaucgugccccggcacugcccagagcuggccgaaaugucccgcguaagcauuaggauccucgacgagcuggugcugccguuucaggaauugcaaauugaugacaaugaguacgcguaccucaaggcaaucauuuucuuugaucccgacgccaaaggccugagugauccagguaagaucaaacggcugaggucccagguccaggugagccucgaagacuauaucaacgaucgccaguacgacagccgggggagguucggcgagcuguugcugcuccugcccacucugcaauccauuaccuggcagaugaucgagcagauucaauuuaucaaguuguucggcauggccaaaauugauaaucuccugcaggaaaugcugcucggggguaguccaagcgacgcaccccaugcccaccacccgcugcauccccacuugaugcaggagcauaugggcacuaacgugaucgucgcgaauaccaugccaacccaccuguccaacgggcagaugugugaauggccccgcccacggggccaagccgcaacgcccgagacuccacagccgagucccccagguggcaguggguccgaacccuauaagcuccugccaggcgccguggcaaccaucguaaagccccugagcgccauuccgcagccaacuaucaccaaacaggaggugauuugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2278 - RNA, 906 nt, Artificial Sequence
  mRNA product Design4 comprising derived and/or modified sequence from Homo sapiens__NP_061986.1__HsFGF21 (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2279 - RNA, 1632 nt, Artificial Sequence
  mRNA product Design4 comprising derived and/or modified sequence from Homo sapiens__NP_078852.3__HsOGFRL1 (opt7)
gggagagucccgcagucggcguccagcggcucugcuuguucgugugugugucguugcaggccuuauucaagcuuaccaugggcaaccugcucgggggugugagcuucagggagcccaccacugucgaagacugcgauuccaccuggcagacggacagugagccagaaccggaggaacccggcccagggggcgguagcgaggggcccggccaagaguccgaacagccagcccagcccccagagcaggcaggcgggcggccgggugccagucccgcgccagaugaagacgccgaggcagccggcgcagagcaagggggcgauagcacugaagccaccgcgaagcccaaacgcuccuuuuacgccgcaagggaccuguauaaguaccggcaccaguauccaaauuucaaagauauccgcuaccagaacgacuugagcaaucugagguuuuauaagaacaaaauucccuucaagccggaugguguguacaucgaggaaguacucuccaaguggaaaggggacuaugagaagcuggaacauaaucacaccuacauucagugguuguuuccccugcgggagcaaggccucaacuucuacgccaaagagcugacuaccuaugaaaucgaggaauuuaagaaaacgaaggaggccauucgcagguuccugcucgcauacaaaaugaugcuggaauuuuucggcaucaaguugacugauaagaccgggaauguggcccgggcggucaacuggcaggagcgcuuucagcaucugaaugagagucagcacaacuaucucaggaucacucggauucugaaaagccugggugaauugggcuacgaguccuucaagagcccacucgugaaauucauccugcaugaagcccugguggagaauaccauucccaacaucaagcaaagugcacucgaauauuuugucuacaccauucgcgacaggcgggagcgcaggaaacuguugcgguucgcccagaagcacuauacgccauccgagaauuuuaucugggggcccccacgcaaggaacagagcgagggcuccaaagcacaaaagaugaguagcccgcuggccuccagccacaacagucagacuuccaugcauaaaaaggccaaagauagcaagaauaguuccagcgcggugcaccucaacagcaagaccgcagaagacaaaaagguagcccccaaagagccaguggaggaaacugacaggcccuccccagagcccaguaacgaagccgcaaagccgcggaauaccgagaaagauagcaacgccgaaaauaugaacucccagccagagaagaccgucacuacgcccaccgagaagaaagaaagcgugagucccgagaauaacgaagaggguggcaaugacaaccaggauaaugaaaacccagggaauacuaacugucaugacgugguccuggugcaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2280 - RNA, 834 nt, Artificial Sequence
  mRNA product Design4 comprising derived and/or modified sequence from Homo sapiens__NP_008842.1__HsRLN1 (opt7)
gggagagucccgcagucggcguccagcggcucugcuuguucgugugugugucguugcaggccuuauucaagcuuaccaugcccaggcuguuccucuuucaccuguuggaguucugccugcuccugaaccaguuuagccgggccguggcagccaaguggaaagacgaugucaucaaguuguguggccgcgaacuggugagggcgcaaauugccaucugcgggauguccaccuggaguaaacggagccucucccaggaggacgcaccacagacuccgcgccccguagccgaaauugugccaaguuucaucaauaaggauaccgagacgauuaucaucaugcuggaauuuauugcaaaccugcccccagagcucaaagccgcgcugagcgagaggcagcccuccuugccagaacugcaacaguacgucccggcccucaaggacagcaaucuguccuucgaggaauuuaagaaacugauccggaaccgccagagugaggcagccgauagcaaucccuccgaguugaaguaucucggucuggacacucauagccagaaaaagaggcggccauacguggcccuguucgaaaaauguugccucauuggcuguaccaagcgcagucuggcaaaauauugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2281 - RNA, 834 nt, Artificial Sequence
  mRNA product Design4 comprising derived and/or modified sequence from Homo sapiens__NP_604390.1__HsRLN2 (opt7)
gggagagucccgcagucggcguccagcggcucugcuuguucgugugugugucguugcaggccuuauucaagcuuaccaugcccaggcuguucuuuuuccaccuccugggcgugugcuugcugcucaaccaguuuagccgggccgucgcagacuccuggauggaggaagugaucaagcugugugggcgcgaguugguaagggcccaaauugcgaucugcgguaugaguaccuggagcaaacggucccugagucaggaagaugccccacagacuccgcgccccguggcagagauuguccccagcuucaucaauaaggacaccgaaacgauuaacaugauguccgaguuuguggccaaucucccacaggagcugaaacugacucucagcgaaaugcaaccagcacugccccaguugcagcagcaugugccaguccugaaggauuccagucuccuguucgaggaauuuaaaaagcugaucaggaaccggcaaagcgaggccgcggacuccagcccgagugaguugaaguaccucggccuggauacccacucccgcaaaaagaggcagcuguauagcgcccucgcaaauaaauguugccaugugggguguaccaagcggucccuggcccgcuucugcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2282 - RNA, 705 nt, Artificial Sequence
  mRNA product Design4 comprising derived and/or modified sequence from Homo sapiens__NP_543140.1__HsRLN3  (opt7)
gggagagucccgcagucggcguccagcggcucugcuuguucgugugugugucguugcaggccuuauucaagcuuaccauggccagguacaugcugcuccuguugcuggcaguguggguccucaccggcgagcuguggcccggggccgaagcgcgggccgcaccauauggugugcgcuugugcggcagggaguucauccgggccguaauuuuuacuugugggggcagccgcuggaggcgguccgacauccuggcacacgaagccaugggugauaccuucccggacgcggaugccgacgaggauagucucgcaggggaacuggacgaggccaugggcagcuccgaguggcuggcccucacgaagaguccccaggcauuuuaccgcggcaggccaagcuggcaagggacucccggugugcugcggggcucccgcgaugucuuggccgggcugagcuccaguugcuguaaauggggcugcagcaaguccgaaauuagcagucucuguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2283 - RNA, 1686 nt, Artificial Sequence
  mRNA product Design4 comprising derived and/or modified sequence from Homo sapiens__NP_002412.1__HsMMP1 (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2284 - RNA, 1446 nt, Artificial Sequence
  mRNA product Design4 comprising derived and/or modified sequence from Homo sapiens__NP_002412.1__HsMMP1(1-19,100-469) (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2285 - RNA, 3633 nt, Artificial Sequence
  mRNA product Design4 comprising derived and/or modified sequence from Clostridium histolyticum__BAA77453.1__ColG (opt7)
gggagagucccgcagucggcguccagcggcucugcuuguucgugugugugucguugcaggccuuauucaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2286 - RNA, 3357 nt, Artificial Sequence
  mRNA product Design4 comprising derived and/or modified sequence from Clostridium histolyticum__BAA77453.1__HsALB(1-18)_ColG(111-1118) (opt7)
gggagagucccgcagucggcguccagcggcucugcuuguucgugugugugucguugcaggccuuauucaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2287 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2288 - RNA, 3381 nt, Artificial Sequence
  mRNA product Design4 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2289 - RNA, 3342 nt, Artificial Sequence
  mRNA product Design4 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2290 - RNA, 3276 nt, Artificial Sequence
  mRNA product Design4 comprising derived and/or modified sequence from Clostridium histolyticum__BAA34542.1__HsALB(1-18)_ColH(41-1021) (opt7)
gggagagucccgcagucggcguccagcggcucugcuuguucgugugugugucguugcaggccuuauucaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2291 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2292 - RNA, 1122 nt, Artificial Sequence
  mRNA product Design4 comprising derived and/or modified sequence from Homo sapiens__NP_003801.1__HsTNFSF10 (opt8)
gggagagucccgcagucggcguccagcggcucugcuuguucgugugugugucguugcaggccuuauucaagcuuaccauggccaugauggaaguacaaggaggccccucacucggccaaaccugcguccucaucguaaucuucaccguccuccuccaaucccucugcgucgcgguaacauacgucuacuucacaaacgaacucaaacaaaugcaagacaaauacuccaaauccggaaucgccugcuuucuaaaagaagacgacuccuacugggaccccaacgacgaagaaagcaugaacucccccuguuggcaagucaaauggcaacuccgccagcucguccgaaaaaugauacuacgcaccuccgaagaaacuaucuccaccguccaagagaaacaacaaaacaucuccccacugguccgagaacgaggcccccaacgcguagccgcccacaucacuggcacacgaggacgcuccaacacccuaucaucccccaacuccaaaaacgaaaaagcccuaggccgcaaaaucaacucaugggagucaucccgauccggccacuccuuccucuccaaccuacaccuacgcaacggagaacucgucauacacgaaaaaggauucuacuacauauauucccaaaccuacuuccgcuuccaagaggaaauaaaagaaaacaccaaaaacgacaaacaaaugguccaauacauauacaaauacacauccuaccccgaccccauacuccucaugaaauccgcccgcaacucuugcugguccaaggacgcagaauacggacucuacucaaucuaccaaggcggaauauucgaacucaaagaaaacgaccgcaucuucguaucaguaaccaacgagcaccucaucgacauggaccacgaagccuccuucuucggcgccuuccucguaggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2293 - RNA, 843 nt, Artificial Sequence
  mRNA product Design4 comprising derived and/or modified sequence from Homo sapiens__NP_003801.1__HsTNFSF10(95-281) (opt8)
gggagagucccgcagucggcguccagcggcucugcuuguucgugugugugucguugcaggccuuauucaagcuuaccaugacaucagaagaaaccaucuccacaguccaagaaaaacaacaaaacaucucaccccuaguacgcgaacgcggcccacaacgcguagccgcacacaucaccggcacccgcggaagauccaacacccucuccucccccaacuccaaaaacgaaaaagcccucggccgaaaaaucaacuccugggaauccagccgaucaggccacucauuccucucaaaccuacaccuccgaaacggcgaacucguaauccacgaaaaaggcuucuacuacaucuacucccaaaccuacuuccgcuuccaagaagaaauaaaagaaaacaccaaaaacgacaaacaaaugguccaauacaucuacaaauacaccuccuacccagaccccauccuacuaaugaaauccgcacgaaacuccugcuggucaaaagacgccgaauacggacucuacuccaucuaccaaggcggaaucuucgaacucaaagaaaacgaccgcaucuucgucagcguaaccaacgaacaccucaucgacauggaccacgaagccagcuucuucggagccuuccuagucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2294 - RNA, 894 nt, Artificial Sequence
  mRNA product Design4 comprising derived and/or modified sequence from Homo sapiens__NP_003801.1__HsALB(1-18)_HsTNFSF10(95-281) (opt8)
gggagagucccgcagucggcguccagcggcucugcuuguucgugugugugucguugcaggccuuauucaagcuuaccaugaaaugggucaccuucaucucccuccuauuccuauucucaucagcauacuccaccagcgaagaaaccaucuccaccguccaagaaaaacaacaaaacaucuccccacucguccgcgaacgcggcccacaacgcgucgccgcccacaucaccggaacccgcggacgauccaacacacuauccucacccaacuccaaaaacgaaaaagcccucggacgcaaaauaaacucaugggaaucaucacgcucaggacacucauuccuguccaaccuccaccuacgaaacggcgaacucgucauccacgaaaaaggauucuacuacauauacucacaaaccuacuuccgcuuccaagaagaaaucaaagaaaacaccaaaaacgacaaacaaaugguccaauacaucuacaaauacaccuccuaccccgaccccauacuacucaugaaaucagcacgaaacuccugcugguccaaggacgccgaauacggccucuacuccauauaccaaggcggcaucuucgaacucaaagaaaacgaccguaucuucguaucaguaaccaacgaacaccucaucgacauggaccacgaagccuccuucuucggagccuuccuagucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2295 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt8)
gggagagucccgcagucggcguccagcggcucugcuuguucgugugugugucguugcaggccuuauucaagcuuaccaugaaaugggugaccuucaucucacuccuauuccuguucucgagcgcauacucgcgcaugaaacaaaucgaggacaaaaucgaagaaauacucucgaaaaucuaccacaucgagaacgaaaucgcacgcaucaaaaagcucauaggcgaaaccucggaagaaaccauaagcacgguccaagaaaagcaacaaaacauaagcccacucguacgcgagcgcggaccccagcgcguggccgcacacauaaccgggaccaggggaagauccaacacccugagcucgcccaacagcaaaaacgaaaaagcgcucgggcgaaaaaucaacagcugggaauccuccaggagcgggcacucguuccuaagcaaccuccaccucagaaacggggaauuagucauacacgagaaaggguucuacuacauauacucacaaacauacuuccgcuuccaagaagaaauaaaagagaacacgaaaaaugacaaacaaaugguccaguauauauacaaauacacaagcuauccagauccaauacuccugaugaaaagcgcgcgcaacagcuguuggucaaaagaugccgaguacggccuauacuccauauaccagggcggaaucuucgaacucaaagaaaacgaucgcaucuucgugagcguaacaaacgaacaccucauagacauggaccacgaagcgagcuucuucggagccuuccucgugggauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2296 - RNA, 1353 nt, Artificial Sequence
  mRNA product Design4 comprising derived and/or modified sequence from Rattus norvegicus__NP_036656.1__RnCebpa (opt8)
gggagagucccgcagucggcguccagcggcucugcuuguucgugugugugucguugcaggccuuauucaagcuuaccauggaaagcgcagacuucuacgaagcagaaccccgcccccccauguccucccaccuccaaucccccccccacgccccuuccaaugcagcauucggcuucccccgcggagcaggacccgcacccccaccagccccccccgccgcccccgaaccccucggcggaauaugcgaacacgaaacauccaucgacauauccgcuuacauugaccccgccgccuucaacgacgaauuccucgcagaccucuuucaacacagccgccaacaggaaaaagcaaaagccgcagccggccccgccggcggcggaggcgacuucgacuaccccggcgccccagccggaccaggaggcgccgucauguccgcaggcgcccacggccccccccccggcuacggcugcgcugccgccggcuaccucgacggccgccucgaaccccucuacgaacgagucggagccccagcacuccgaccacucguaaucaaacaagaaccccgcgaagaagacgaagcgaaacaacuugcacucgcaggccuauuccccuaccaaccccccccaccccccccacccccccacccccacgcauccccagcccaccucgccgcaccccaccuccaauuccaaauagcccauugcggccaaaccaccaugcaccuccaaccaggccaccccaccccaccccccacacccguaccaucgccucacccagcccccgcaaugggcgccgccggccuaccuggcccaggcggcagccucaaaggacuugcaggcccacaccccgaccucagaacaggcggcggcggcggcggaggcgccggcgccggcaaagcaaaaaaaucagucgacaaaaacuccaacgaauaccgaguccgacgcgaacgcaacaacaucgccguccgcaaaucccgcgacaaagccaaacaaagaaacguagaaacacaacaaaaaguucucgaacuuacaucagacaaugacagacuucgcaaacgcgucgagcaacuaucccgcgaacucgacacccuccgagguaucuuccgacaacuccccgaauccucccucgucaaagccaugggaaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2297 - RNA, 1311 nt, Artificial Sequence
  mRNA product Design4 comprising derived and/or modified sequence from Rattus norvegicus__NP_036656.1__RnCebpa(15-344) (opt8)
gggagagucccgcagucggcguccagcggcucugcuuguucgugugugugucguugcaggccuuauucaagcuuaccauguccucccaccuccaaucccccccacacgcaccauccaacgccgccuucggcuuccccagaggcgccggccccgcccccccccccgccccccccgccgcccccgaaccccuaggcggcauaugcgaacacgaaaccuccaucgacaucucagccuacauagaccccgccgcauucaacgacgaauuccucgccgaccuuuuccaacacagccgucaacaagaaaaagccaaagccgccgccggaccagccggcggcggcggcgacuucgacuacccaggcgcccccgccggacccggcggcgccgucaugucagcaggagcccacggcccaccucccggcuacggaugcgccgcagcaggcuaccucgacggcagacuagaaccacuauacgaacgcgugggagcacccgcacuccgaccccucguaaucaaacaagaaccaagagaagaagacgaagccaaacaacucgcacucgccggccucuuccccuaccaaccacccccaccccccccacccccccacccccacgcauccccagcacaccuagccgccccccaccuucaauuccaaaucgcacacugcggccagacaacaaugcaccuccaacccggccaccccacacccccucccacccccgucccauccccccacccagcccccgcaaugggcgccgccggacuaccaggacccggcggaucccuaaaaggacucgccggcccccaccccgacuuacgcaccggcggcggcggcggcggaggcgccggggcaggcaaagccaaaaaauccgucgacaaaaacucaaacgaauacagaguacgccgagaacgaaauaacaucgccguccgaaagucacgcgacaaagcaaaacaacgaaacgucgaaacacaacaaaaaguacuagaacucaccuccgacaacgaccgacuacgaaaacgcgucgaacaacuuucacgcgaacucgacacccuccgcggaaucuuccgacaacuaccagaaucaucccuugucaaagccaugggaaauugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2298 - RNA, 1356 nt, Artificial Sequence
  mRNA product Design4 comprising derived and/or modified sequence from Mus musculus__NP_031704.2 __MmCebpa (opt8)
gggagagucccgcagucggcguccagcggcucugcuuguucgugugugugucguugcaggccuuauucaagcuuaccauggaauccgccgacuuuuacgaaguagaaccccgcccacccauguccucccaucugcaaucaccuccccacgcccccuccaacgccgcauucggauucccccgcggcgcaggacccgccccacccccagccccacccgcagcccccgaaccccucggcggcauuugcgaacacgaaaccuccaucgacaucucagccuacauagaccccgccgccuucaacgacgaguuccucgccgaccuuuuccaacacucccgccaacaagaaaaagccaaagcagccgccggccccgccggaggcggcggagacuucgacuaccccggcgcacccgccggacccggaggcgccgucaugucagcaggcgcccauggacccccacccggcuacggaugugcagccgccggauacuuagacggccgccuagaaccccucuacgaacgcguaggcgcccccgcccuucgcccccucguuaucaaacaagaaccccgcgaagaagacgaagccaaacaacuagcccuagccggccucuuccccuaccaacccccacccccacccccgccaccccacccccaugcaucccccgcccaccuagccgcuccccaccuacaauuccaaaucgcacacugcggccaaacaaccaugcacuuacaacccggccaccccacacccccacccacccccgucccgucaccccacgccgccccagcccuaggagccgccggccuccccggacccggcuccgcccuaaaaggacucgccggcgcccacccagaccuccgaacaggcggcggcgguggcggcuccggcgccggggcaggaaaagccaagaaauccguagacaaaaacuccaacgaauaccgcguccgacgcgaaagaaacaacaucgccguccgaaaaucccgcgacaaagcaaaacaaagaaacgucgaaacacaacaaaaaguccuagaacuaaccuccgacaacgaccgccuucguaaacgcguagaacaacuaucccgcgaacucgacacccuacgcggcaucuuccgccaacuccccgaaucaucccucguuaaagcaaugggcaacugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2299 - RNA, 1314 nt, Artificial Sequence
  mRNA product Design4 comprising derived and/or modified sequence from Mus musculus__NP_031704.2 __MmCebpa(15-359) (opt8)
gggagagucccgcagucggcguccagcggcucugcuuguucgugugugugucguugcaggccuuauucaagcuuaccaugucaagccaccuccaaucacccccccacgcccccucuaacgccgcauucgguuucccccgaggcgccgguccagccccacccccugcgcccccagccgccccagaaccccuuggaggaaucugcgaacacgaaaccuccauagacauaucagccuacaucgaccccgccgccuucaacgaugaauuccuagccgaccucuuccaacacucacgccaacaagaaaaagcaaaagccgccgccggcccagccggcggcggaggagacuucgacuacccaggcgcacccgcaggaccgggaggagccguaauguccgcaggcgcccacggcccaccccccggauacggaugcgcagccgccggcuaccucgacggacgacuagaaccacucuacgaaagagucggcgcccccgcccuacgcccccucguaauaaaacaagaaccccgagaagaagacgaagccaaacaacucgcccucgccggacucuuccccuaccaaccgccccccccccccccccccccacacccacacgcaucaccagcccaccuagcagccccccaccuacaauuccaaauagcccacugcggacaaaccaccaugcaccuacaaccaggccaccccaccccaccucccaccccagucccauccccacacgccgccccagcccucggcgccgccggacucccaggacccggcucagcccucaagggacuagccggagcacaccccgaccuccgaacaggcggaggaggcggcggcuccggagcuggugccggaaaagcaaaaaaauccgucgacaaaaacuccaacgaauacagaguccgccgagaacgaaacaacauagccguccgaaaaucccgagacaaagcaaaacaacgaaacgucgaaacccaacaaaaaguccuagaacuaaccucugacaacgaccgacuacgcaaacgagucgaacaacucagcagagaacucgacacccucagaggaauauuccgacaacuaccagaauccucccuagucaaagcuaugggaaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2300 - RNA, 1353 nt, Artificial Sequence
  mRNA product Design4 comprising derived and/or modified sequence from Homo sapiens__NP_004355.2__HsCEBPA (opt8)
gggagagucccgcagucggcguccagcggcucugcuuguucgugugugugucguugcaggccuuauucaagcuuaccauggaauccgccgacuucuacgaagccgaaccacgaccccccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2301 - RNA, 1311 nt, Artificial Sequence
  mRNA product Design4 comprising derived and/or modified sequence from Homo sapiens__NP_004355.2__HsCEBPA(15-358) (opt8)
gggagagucccgcagucggcguccagcggcucugcuuguucgugugugugucguugcaggccuuauucaagcuuaccaugucuucccaucuccaaucucccccacacgcacccucauccgcagcauucggauucccacgaggcgccggccccgcccaaccccccgcaccacccgcagcccccgaaccacucggcggcaucugcgaacacgaaacaagcaucgacaucuccgcauacaucgaccccgccgccuucaacgacgaauuucucgccgaccuauuccaacacucccgccaacaagaaaaggccaaggccgccgucggccccaccggaggcggcggaggcggagacuucgacuacccaggggcaccagcaggaccaggcggcgcagucaugcccggaggcgcccacggcccacccccaggcuacgguugcgccgccgccggauaccucgacggccgacuugaaccccuauacgaacgcguaggagcccccgcccuacgcccccuaguaaucaaacaagaaccacgagaagaagacgaagccaaacaacucgcccuagcaggccuauucccuuaucaacccccaccaccucccccacccucacacccccacccacacccacccccagcacaccucgcagccccccaccuccaauuccaaaucgcccacugcggacaaaccacaaugcaccuacaaccaggccacccaacccccccccccacccccgucccauccccacacccagcuccugcacucggcgccgccggccuacccggacccggcuccgcacuuaaaggacuaggagccgcccaccccgaccuccgagccuccggcgguuccggcgcaggcaaagccaaaaaauccguagacaaaaacagcaacgaauacagaguccgccgcgaacgaaacaacaucgcaguacgcaaaagcagagacaaagccaaacaacgcaacgucgaaacucaacaaaaaguacucgaacucacauccgacaacgaccgccuccgaaaacgcguagaacaacucucccgcgaacuagacacccuaagaggaaucuuccgccaacucccagaauccagccuggucaaagcaaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2302 - RNA, 1701 nt, Artificial Sequence
  mRNA product Design4 comprising derived and/or modified sequence from Homo sapiens__NP_000448.3__HsHNF4A (opt8)
gggagagucccgcagucggcguccagcggcucugcuuguucgugugugugucguugcaggccuuauucaagcuuaccaugcgccuauccaaaacacucguagacauggauauggcagacuacuccgccgcccucgaccccgccuacacaacucuagaguucgaaaacguccaaguccucaccaugggcaacgauaccuccccauccgaaggaaccaaccucaacgccccaaacucccucggcgucucagcccuaugcgccaucugcggagaccgcgccaccgggaaacacuacggcgccucguccugugacgggugcaaagguuucuuccgccgcuccguccgcaaaaaucacauguacuccugccgauucucccgacaaugcgucguagacaaagauaaaagaaaccagugccgcuacugccgccugaagaaaugcuuccgcgcaggaaugaagaaagaagccguccaaaacgaacgcgaccgcaucucaacccgacgcuccucauaugaagacuccagccuccccucaaucaacgcacuacuacaagccgaaguccucagccgccaaauaacaucaccugucucuggcaucaacggagacaucagagcaaagaaaauugcaucaaucgcagacgucugcgaaucuaugaaagaacaacuccucguccugguugaaugggccaaauacaucccagccuucugcgaacucccccucgacgaccaagucgcacuacuccgcgcacacgccggcgaacaccuccuacucggcgccacaaaacgcuccauggucuucaaagacguccuccuccuaggcaacgacuacaucguccccagacacugccccgaacucgccgaaaugagccgagucucaauccggauacuagacgaacucguacucccauuccaagagcuucaaauagacgacaaugaauacgccuaccuuaaagcaauaauauucuucgauccagacgcuaaaggacucucugaccccggcaaaaucaaacgcuuacgaucccaaguccaagucucacuagaagacuacaucaacgaccgacaauacgacucccgcggcagauucggggaacuccuccuccuccuacccacacuccaaagcaucaccuggcaaaugaucgaacaaauccaauucauaaaacucuucggaauggccaaaaucgacaaccuccuacaagaaaugcuacucggcggcucccccuccgacgcaccccacgcccaucacccccuccacccacaccucaugcaagaacacaugggcaccaacguaauagucgccaacaccaugccaacccaccuaucaaacggucaaaugugcgaauggccuagaccccguggccaagccgccacgcccgaaacaccacagcccuccccacccggcggcuccggcucagaacccuacaaacuacuacccggagccgucgccacaaucguaaaaccccuaucggccaucccccaacccaccaucaccaaacaagaagucaucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2303 - RNA, 906 nt, Artificial Sequence
  mRNA product Design4 comprising derived and/or modified sequence from Homo sapiens__NP_061986.1__HsFGF21 (opt8)
gggagagucccgcagucggcguccagcggcucugcuuguucgugugugugucguugcaggccuuauucaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2304 - RNA, 1632 nt, Artificial Sequence
  mRNA product Design4 comprising derived and/or modified sequence from Homo sapiens__NP_078852.3__HsOGFRL1 (opt8)
gggagagucccgcagucggcguccagcggcucugcuuguucgugugugugucguugcaggccuuauucaagcuuaccaugggcaaccuacucggcggcgucucguuccgcgaaccaaccaccguagaggacugcgacagcaccuggcaaaccgacuccgaaccugaacccgaagaacccggccccggcggcggcagcgaaggccccggccaagaaucggaacaacccgcccaacccccagaacaagccggcggacgacccggcgccucacccgccccagacgaagacgcagaagccgccggggccgagcaaggcggcgacucuaccgaagccacagcuaaaccaaaacggagcuucuacgccgcccgcgaccucuacaaauaccgccaccaauaccccaacuucaaagacauccgcuaccaaaacgaccuauccaaucuucgcuuuuauaaaaacaaaauaccuuucaaacccgacggcgucuacaucgaagaaguucuaagcaaauggaaaggcgacuacgaaaaacucgaacacaaccacaccuacauccaauggcuauucccgcuacgcgaacaaggccugaacuucuaugccaaagaacuaaccaccuacgaaauagaagaguucaaaaaaaccaaagaagcaauacgccgcuuccuccuagccuacaaaaugaugcucgaauuuuucgggaucaaacuaaccgacaaaaccggcaacgucgcccgcgcuguaaauuggcaagaacgauuccaacaccuaaacgagucccagcacaacuaccuaagaaucacccgaauacucaaaucccucggagagcucggcuacgaauccuucaaauccccacucgucaaguucauccuccacgaggcccucgucgagaacaccauccccaacaucaaacaguccgcacuagaauacuucguguacaccauccgcgaccgccgugaacgacgcaaacuccuacgcuucgcccaaaaacacuacacacccuccgaaaacuucaucuggggcccacccagaaaagaacaauccgaaggauccaaagcccaaaaaauguccagcccacuagccagcucccauaacucacaaacaucaaugcacaaaaaggccaaagacucaaaaaacuccuccagcgccguacaccucaacuccaaaaccgccgaagacaaaaaagucgcccccaaggaacccgucgaagaaacagaccgcccaucgccagaacccucaaacgaagccgcaaaaccccgcaacaccgagaaagacucaaaugccgaaaauaugaacucgcaacccgagaaaacagucaccacccccacagaaaaaaaagaauccgugagcccagaaaacaacgaagaaggcggcaacgacaaccaagacaacgaaaacccuggaaacaccaacugccacgacgucguacucguacaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2305 - RNA, 834 nt, Artificial Sequence
  mRNA product Design4 comprising derived and/or modified sequence from Homo sapiens__NP_008842.1__HsRLN1 (opt8)
gggagagucccgcagucggcguccagcggcucugcuuguucgugugugugucguugcaggccuuauucaagcuuaccaugccccgccucuuccucuuccaccuccuagaauuuugccuccuccucaaccaauucucccgcgccgucgccgccaaauggaaagacgacguuauaaaacucugcggccgcgaacucguccgcgcccaaaucgccaucugcggcaugucaaccugguccaaacgcucacucucacaagaagacgccccccaaaccccccgcccagucgccgaaaucgucccaucauucaucaacaaagacacagaaaccauaaucaucaugcucgaauuuauagccaaccucccccccgaacucaaagccgcccucuccgaacgacaacccucccuccccgaacuacaacaauacgucccagcccucaaagacucaaaccucucauuugaagaauuuaaaaaacuaauccgcaaccgacaauccgaagccgccgacuccaaccccuccgaacuaaaauaccucggccuugacacccacagccaaaaaaaacgcagacccuacgucgcacucuucgaaaaaugcugccucaucggaugcaccaaacgcucccucgccaaauacugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2306 - RNA, 834 nt, Artificial Sequence
  mRNA product Design4 comprising derived and/or modified sequence from Homo sapiens__NP_604390.1__HsRLN2 (opt8)
gggagagucccgcagucggcguccagcggcucugcuuguucgugugugugucguugcaggccuuauucaagcuuaccaugccccgccucuucuucuuccaccuccucggcguaugccuccuccucaaccaauucucccgcgccgucgccgacuccuggauggaagaagucaucaaacucugcggacgcgaacucguccgcgcccaaaucgccauaugcggcauguccacuugguccaaacgcucccucucccaagaggacgcaccacaaaccccccgacccgucgcagaaaucgucccauccuucaucaacaaagacaccgaaacuaucaacaugaugucagaauuugucgcaaaccucccccaagaacuuaaacucacccucuccgaaaugcaacccgcccucccccaacuacaacaacacguccccguacuaaaagacuccucccuccucuuugaagaauuuaaaaaacuaauccgcaaccgccaaucagaagccgccgacagcucccccucagaacucaaauaccucggacucgacacacacucccgcaaaaaacgccaacuauacucagcacucgccaacaaaugcugccacgucggcugcaccaaacgcucacucgcccgauucugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2307 - RNA, 705 nt, Artificial Sequence
  mRNA product Design4 comprising derived and/or modified sequence from Homo sapiens__NP_543140.1__HsRLN3  (opt8)
gggagagucccgcagucggcguccagcggcucugcuuguucgugugugugucguugcaggccuuauucaagcuuaccauggcgagauauauguugcuacugcucuuggccgugugggugcucacgggagagcucuggcccggggccgaggccagggccgcgcccuauggagugcgauugugcgggcgcgaguucauacgcgcgguaauauucacgugcgggggaucgcgcuggcgcaggagcgauaucuuggcccaugaagcgaugggggacacauucccggacgcagacgcggacgaggacucgcucgcgggcgagcucgaugaagcgauggggaguucggaauggcuagcgcuaacgaaaucgccccaggccuuuuacaggggcaggccaucauggcagggaacgcccgggguccugcgagggagcagggacguguuagcgggcuugagcucaagcuguugcaagugggggugcucgaaaucagaaauaagcucgcucuguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2308 - RNA, 1686 nt, Artificial Sequence
  mRNA product Design4 comprising derived and/or modified sequence from Homo sapiens__NP_002412.1__HsMMP1 (opt8)
gggagagucccgcagucggcguccagcggcucugcuuguucgugugugugucguugcaggccuuauucaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2309 - RNA, 1446 nt, Artificial Sequence
  mRNA product Design4 comprising derived and/or modified sequence from Homo sapiens__NP_002412.1__HsMMP1(1-19,100-469) (opt8)
gggagagucccgcagucggcguccagcggcucugcuuguucgugugugugucguugcaggccuuauucaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2310 - RNA, 3633 nt, Artificial Sequence
  mRNA product Design4 comprising derived and/or modified sequence from Clostridium histolyticum__BAA77453.1__ColG (opt8)
gggagagucccgcagucggcguccagcggcucugcuuguucgugugugugucguugcaggccuuauucaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2311 - RNA, 3357 nt, Artificial Sequence
  mRNA product Design4 comprising derived and/or modified sequence from Clostridium histolyticum__BAA77453.1__HsALB(1-18)_ColG(111-1118) (opt8)
gggagagucccgcagucggcguccagcggcucugcuuguucgugugugugucguugcaggccuuauucaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2312 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt8)
gggagagucccgcagucggcguccagcggcucugcuuguucgugugugugucguugcaggccuuauucaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2313 - RNA, 3381 nt, Artificial Sequence
  mRNA product Design4 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2314 - RNA, 3342 nt, Artificial Sequence
  mRNA product Design4 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2315 - RNA, 3276 nt, Artificial Sequence
  mRNA product Design4 comprising derived and/or modified sequence from Clostridium histolyticum__BAA34542.1__HsALB(1-18)_ColH(41-1021) (opt8)
gggagagucccgcagucggcguccagcggcucugcuuguucgugugugugucguugcaggccuuauucaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2316 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt8)
gggagagucccgcagucggcguccagcggcucugcuuguucgugugugugucguugcaggccuuauucaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2317 - RNA, 1122 nt, Artificial Sequence
  mRNA product Design4 comprising derived and/or modified sequence from Homo sapiens__NP_003801.1__HsTNFSF10 (opt9)
gggagagucccgcagucggcguccagcggcucugcuuguucgugugugugucguugcaggccuuauucaagcuuaccauggccaugauggaaguccaaggcggaccaucccucggccaaaccugcguccuaaucgucaucuucaccguccuccuccaaucacucugcguagccgucaccuacguauacuucacaaacgaacuaaaacaaaugcaggacaaauacuccaaauccggcaucgccugcuuccucaaagaagacgacuccuacugggacccaaacgacgaagaauccaugaacuccccaugcuggcaagucaaauggcaacuccgccaacucguccgcaaaaugauccuccgcaccagcgaagaaaccaucagcacaguacaagaaaaacaacaaaacaucagcccccucguacgcgagagaggaccccaacgcguagcagcccacaucacaggcaccagaggccgcuccaacacccucuccucccccaacuccaaaaacgaaaaagcccucggccgcaaaaucaacuccugggaaagcucccgcucaggccacucauucuuauccaaccuacaccuccgcaacggagaacucguaauccacgaaaaaggcuucuacuacaucuacucccaaaccuacuuccgcuuccaagaagaaaucaaagaaaacacuaaaaacgacaaacagaugguccaauacaucuacaaauacaccuccuaccccgaccccauacuccucaugaaaagcgccagaaacuccugcuggagcaaagacgccgaauacggccuauacuccaucuaccaaggcggcaucuucgaacucaaagaaaacgaccgaaucuucgucuccguaaccaacgaacaccuaaucgacauggaccacgaagccuccuucuucggagcuuuccucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2318 - RNA, 843 nt, Artificial Sequence
  mRNA product Design4 comprising derived and/or modified sequence from Homo sapiens__NP_003801.1__HsTNFSF10(95-281) (opt9)
gggagagucccgcagucggcguccagcggcucugcuuguucgugugugugucguugcaggccuuauucaagcuuaccaugaccucagaagaaaccaucuccacaguccaagaaaaacaacaaaacauaagcccccucguccgcgaacgcggaccccaacgcguagccgcacacaucaccggaacccgcggccgauccaacacccucuccucacccaacuccaaaaacgaaaaagcccucggccgcaaaaucaacuccugggaaucaucccgcuccggccacuccuuccuaucaaaccuccaccuacgaaacggcgaacucgucauccacgaaaaaggcuucuacuacaucuacucccaaacauacuuccgauuccaagaagaaaucaaagaaaacaccaaaaacgacaaacaaaugguccaauacaucuacaaauacacauccuaccccgacccaauacuacucaugaaaagcgcccgcaacuccugcuggucaaaagacgccgaauacggacucuacuccaucuaccaaggcggcaucuucgaacugaaagaaaacgaccgcauauucguauccgucaccaacgaacaccucaucgacauggaccacgaagccagcuucuucggcgccuuucucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2319 - RNA, 894 nt, Artificial Sequence
  mRNA product Design4 comprising derived and/or modified sequence from Homo sapiens__NP_003801.1__HsALB(1-18)_HsTNFSF10(95-281) (opt9)
gggagagucccgcagucggcguccagcggcucugcuuguucgugugugugucguugcaggccuuauucaagcuuaccaugaaauggguaacauucaucucccuccuauuccuauucuccuccgccuacuccaccuccgaagaaaccauauccacaguccaagaaaaacaacaaaacauaucaccccucguacgagaacgaggcccccaacgcgucgccgcacacaucaccggcacccgcggccgcuccaacacccucuccucacccaacuccaaaaacgaaaaagcccucggccgcaaaaucaacuccugggaauccucacgauccggccacuccuuccucucaaaccuccaccuccgcaacggcgaacucgucauccacgaaaaaggcuucuacuacaucuacucacaaacauacuuucgcuuccaagaagaaaucaaagaaaacaccaaaaacgacaaacaaaugguccaauacaucuacaaauacaccucuuaccccgacccaauccuccucaugaaaucagcccgcaacuccugcugguccaaagacgccgaauacggccucuacuccauauaccaaggcggcauauucgaacuaaaagaaaacgaccgaauauucgucuccguaaccaacgaacaccucaucgacauggaccacgaagccucauucuucggagccuuucucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2320 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt9)
gggagagucccgcagucggcguccagcggcucugcuuguucgugugugugucguugcaggccuuauucaagcuuaccaugaaauggguaaccuucaucucccuccucuuccucuuuuccuccgccuacucccgcaugaaacaaauagaagacaaaaucgaagaaauccucuccaaaaucuaccacaucgaaaacgaaauagcacgaaucaagaaacuaauaggagaaaccuccgaagaaaccauauccaccguccaggaaaaacaacaaaacauaagcccccucguccgcgaacgcggaccccaacgcgucgccgcccacaucaccgggacccgaggccgauccaacacccugagcucacccaacagcaaaaacgaaaaagcacuaggccgcaaaaucaacuccugggaauccuccagauccggccacuccuuccuaagcaaccuccaccucagaaacggcgaacucguaauccacgaaaaaggcuucuacuacaucuacucacaaaccuacuuccgcuuccaagaagaaaucaaagaaaacaccaaaaacgacaaacaaaugguccaauacaucuacaaauacacaagcuaccccgacccaauccuccuaaugaaaagcgcccgcaacuccugcuggucaaaagacgccgaauacggacucuacuccauauaccaaggcggcaucuucgaacucaaagaaaacgaccgcaucuucgucuccgucacaaacgaacaccucauagacauggaccacgaagccuccuucuucggagccuuccucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2321 - RNA, 1353 nt, Artificial Sequence
  mRNA product Design4 comprising derived and/or modified sequence from Rattus norvegicus__NP_036656.1__RnCebpa (opt9)
gggagagucccgcagucggcguccagcggcucugcuuguucgugugugugucguugcaggccuuauucaagcuuaccauggaauccgccgacuucuacgaagccgaaccccgacccccaaugucaagucaucuccaaagcccaccccacgcacccuccaacgccgccuucggauuccccagaggcgccggacccgcacccccaccagcaccacccgcagcacccgaaccccuaggagguaucugcgaacacgaaaccucaauagacaucuccgcauacauagacccagcagccuucaacgacgaguuccuagccgaccuauuccaacacagccgacaacaagaaaaagccaaagccgcagcaggacccgcaggaggaggcggagacuucgacuacccaggcgcaccagccggaccaggaggagcaguaauguccgccggagcccacggcccaccacccggcuacgggugcgcagccgcgggcuaucuugacggccgccucgaaccccucuacgaacgaguaggcgcacccgcccucagaccccucgucauaaaacaagaaccccgugaagaagacgaagcaaaacaacucgcccucgcaggccuauuccccuaccaacccccaccuccaccacccccaccccacccccacgcaagccccgcacaccuugcagcgccccaccuccaauuccaaauagcccacugcggacaaaccaccaugcaccuccaaccaggccaccccacaccaccacccaccccaguucccucaccccaccccgccccagccaugggagccgcaggccuacccggacccggaggaucccucaaaggccuagccggcccccacccagaucuccgaacaggaggcggaggaggaggcggagccggagcaggcaaagcgaagaaauccgucgacaaaaauuccaacgaauaccgagucagacgcgaacgcaacaacauagccguccgaaaaucccgagacaaagccaaacaaagaaacguagaaacacaacaaaaaguccucgaacuaacaagcgacaacgaccgccuacgcaaacgcgucgaacaacucucccgagaacuagacacccuacgcggaaucuuucgccaacuccccgaaucaagccuaguaaaagcuaugggcaacugcgcgugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2322 - RNA, 1311 nt, Artificial Sequence
  mRNA product Design4 comprising derived and/or modified sequence from Rattus norvegicus__NP_036656.1__RnCebpa(15-344) (opt9)
gggagagucccgcagucggcguccagcggcucugcuuguucgugugugugucguugcaggccuuauucaagcuuaccaugucaucccaucuccaaucacccccccacgccccauccaacgccgccuucggcuucccgcggggcgcuggacccgcaccaccccccgcaccccccgccgcacccgaaccccucggcggcaucugcgaacacgaaaccucaauagacaucuccgcauacauagacccagcugccuucaacgaugaauuccuagccgaccucuuccaacacucccgccaacaagaaaaagcaaaagcagcagccggacccgcaggcggaggaggagacuucgacuacccaggagcuccagcaggacccggcggagcagucauguccgcaggcgcacacggacccccacccggcuacggaugcgcagccgcaggcuaccucgacggccgccucgaaccccuauacgaacgcguaggagccccagcccucagaccacucgucauaaaacaagaaccccgagaagaagacgaagccaaacaacuagcccucgccggccucuucccauaccaaccaccaccucccccaccccccccacacccccacgccucaccagcccaccuagccgcaccacaccuacaauuccaaauagcccacugcggucaaacuaccaugcaccuacaacccggccacccaacaccaccaccaacacccgucccauccccccaucccgcacccgcaaugggagccgccggccuacccggccccggaggcucacucaaaggccuagccggcccccaccccgaccuaagaaccggaggcggaggcggcggcggagccggcgccggaaaagcaaaaaaguccguagacaaaaacucaaacgaauaccgagucagacgagaacgcaacaacauagccguccgcaaaucaagagacaaggcaaaacaaagaaacguugaaacccaacagaaaguacucgaacuaaccagcgacaacgaccgccuccgcaaacgcguagaacaauuaucccgugaacuagacacccuccgaggcauauuccgccaacucccagaaucgucccuagucaaagccaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2323 - RNA, 1356 nt, Artificial Sequence
  mRNA product Design4 comprising derived and/or modified sequence from Mus musculus__NP_031704.2 __MmCebpa (opt9)
gggagagucccgcagucggcguccagcggcucugcuuguucgugugugugucguugcaggccuuauucaagcuuaccauggaauccgccgacuucuacgaaguagaaccccgcccacccauguccucucaccuccaaucccccccccacgcaccauccaacgcagccuucggcuucccacgaggcgccggacccgcacccccccccgcacccccagcagcccccgaaccccuuggcggaaucugcgaacacgaaaccucaaucgacauuucagccuacauagaccccgccgcauucaacgacgaguuccuagccgaccucuuccaacacucccgccaacaagaaaaagcaaaagcagcagcaggaccagcaggcggcggaggcgauuucgacuaccccggcgcacccgcaggcccaggcggcgcagucauguccgccggugcccacggcccaccacccggcuacggcugcgccgccgccggcuaccucgacggcagacuagaaccccucuacgaacgugucggcgcccccgcccuacgaccacucgucaucaaacaagaaccucgcgaagaagacgaagcuaaacaacuagcccucgccggccuauucccauaccaacccccccccccgccaccccccccacacccacacgccucccccgcccaccucgcagcaccccaccuccaauuccaaauagcacacugcggccaaaccaccaugcacuuacaacccggacaccccaccccaccccccaccccagucccauccccccacgccgccccagcccucggcgcagccggccuccccggacccggcagcgcucucaaaggccucgccggcgcccaccccgaccuccgcaccggcggcggcgguggcggcucaggugccggcgcgggcaaagccaaaaaaagcguagacaaaaacucaaacgaauaccgcguccgacgcgaacgaaacaacaucgccguucgcaaaagccgagacaaagccaaacaacgcaacgucgaaacccaacaaaaaguacuagaacucacaucagacaacgaccgucuacgaaaacgagucgaacaacuaucacgagaacucgacacacuacgcggaaucuuccgacaacuucccgaaucaucccucguaaaagccaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2324 - RNA, 1314 nt, Artificial Sequence
  mRNA product Design4 comprising derived and/or modified sequence from Mus musculus__NP_031704.2 __MmCebpa(15-359) (opt9)
gggagagucccgcagucggcguccagcggcucugcuuguucgugugugugucguugcaggccuuauucaagcuuaccauguccagccacuuacaaucacccccccacgcccccuccaacgccgcauucggcuuccccagaggcgccggcccagcacccccuccagcccccccagccgccccagaaccccuuggcggcaucugcgagcacgaaaccucuauagacaucucggcauacaucgaccccgccgccuucaacgacgaauucuuagccgaccuauuccaacacucccgccaacaagaaaaagccaaagccgcagccggacccgccggcggcggaggcgacuucgacuaccccggagcacccgccggccccgggggcgcaguaaugucagccggcgcacacggcccccccccaggcuacggaugcgccgccgccggauaccuagacggccgacucgaaccccucuaugaacgugucggcgcccccgcccuccgaccccuagucaucaaacaagaaccccgcgaagaagacgaagcaaaacaacucgcccucgccggccucuucccauaccaacccccaccccccccaccccccccccacccacacgccucucccgcccaccuagcagcuccccaccuccaauuccaaauagcucacugcggacaaaccacgaugcaccuacaacccggacaccccacuccacccccaacacccguaccuuccccacacgcagcacccgcccucggcgcagcaggccuacccggccccggaucagcccucaaaggccucgcaggcgcccacccagaccuacgaaccggaggcggcggcggcggcuccggagcuggcgccggcaaagccaaaaaaucaguagacaaaaacuccaacgaauaccgaguccgcagagaacgaaacaacaucgcaguccgcaaaucccgcgacaaagccaaacaacgaaacguugaaacacaacaaaaaguacuagaacucaccuccgauaacgaccgacuaagaaaacgagucgaacaacucucccgcgaacucgacacccuaagaggcaucuuccgacaacuccccgaauccucccucgucaaagcaaugggaaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2325 - RNA, 1353 nt, Artificial Sequence
  mRNA product Design4 comprising derived and/or modified sequence from Homo sapiens__NP_004355.2__HsCEBPA (opt9)
gggagagucccgcagucggcguccagcggcucugcuuguucgugugugugucguugcaggccuuauucaagcuuaccauggaauccgcagacuucuacgaagccgaaccccgaccccccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2326 - RNA, 1311 nt, Artificial Sequence
  mRNA product Design4 comprising derived and/or modified sequence from Homo sapiens__NP_004355.2__HsCEBPA(15-358) (opt9)
gggagagucccgcagucggcguccagcggcucugcuuguucgugugugugucguugcaggccuuauucaagcuuaccauguccucacaccuccaauccccaccucacgcccccucaucagcagccuucggauucccccgaggagcaggccccgcucaaccacccgcaccucccgccgcaccagaaccgcuaggcggaauaugcgaacacgaaaccucaaucgacauaagcgcauacauagacccagccgcauucaacgacgaauuucucgccgaccucuuucaacacucccgacaacaagaaaaagcaaaagccgccgucggcccaacaggcggcggaggcggcggagacuucgacuaccccggcgcacccgccggaccaggcggagcagucaugcccggaggagcacacgguccaccccccggauauggcugcgccgccgccggauaccuagacggccgacucgaaccccuauacgaacgaguaggcgcacccgcccuacgcccacuugucaucaaacaagaaccccgagaagaagacgaagcaaaacaacuagcacucgccggucucuucccauaccaaccaccccccccucccccccccucacacccccacccccacccaccccccgcccaccucgcagccccccaccuucaauuccaaauagcccacugcggccaaacaaccaugcaccuacaaccgggccacccuaccccccccccaacaccagucccaucaccccacccagccccagcacuaggagccgcaggcuuacccgguccuggaagcgcccuuaaaggccucggcgccgcccaccccgaccucagagcuuccggcggcuccggcgcaggaaaagcgaaaaaaucagucgacaaaaacuccaacgaauaccgaguacgacgcgaacgcaacaacaucgccguccgcaaaucacgcgacaaagcuaaacaacgcaacgucgaaacccaacaaaaaguucucgaacucaccuccgacaacgaccgccuucgcaaacgcgucgagcaacuaucccgcgaacucgacacccuacgcggaaucuuccgucaacuccccgaauccucccuagucaaagccaugggaaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2327 - RNA, 1701 nt, Artificial Sequence
  mRNA product Design4 comprising derived and/or modified sequence from Homo sapiens__NP_000448.3__HsHNF4A (opt9)
gggagagucccgcagucggcguccagcggcucugcuuguucgugugugugucguugcaggccuuauucaagcuuaccaugcgccuaagcaaaacccuugucgacauggacauggcagacuacucagccgcacucgaccccgcauacacaacacucgaauuugaaaacguacaaguccuaacaaugggcaacgacacaucaccaagcgaagguaccaaucuaaacgcccccaacagccugggcgucucagcucuuugcgcaaucugcggcgaccgcgcaaccgguaaacacuacggcgccuccuccugcgacggcugcaaaggauucuuccgccguuccguucgcaaaaaccacauguacuccugccgauuuagccgacaaugcgucgucgacaaagacaaaagaaaccaaugccgcuauugccgccucaaaaaaugcuuccgcgccggaaugaaaaaagaagcaguccaaaacgaacgcgaccgcaucagcacacgacgaucguccuacgaagacuccucacuacccucaaucaaugcacuccuccaagccgagguccuaucccgacaaaucaccucacccgucuccggcauaaacggcgacauucgcgccaaaaaaaucgccuccaucgccgacgucugcgaguccaugaaagagcaacuccucguccucgucgaaugggccaaauacauccccgcauucugugaacucccccucgacgaccaagucgcccuacuucgcgcccacgccggcgaacaucuccuccuaggcgccaccaagcgguccaugguauucaaagacguccuacuccucggcaacgacuacaucgucccccgacauugcccagaacucgccgaaaugucacgagucuccauccgaauacuugacgaacucguccuacccuuccaagaacuccaaaucgacgacaacgaguacgccuaccuaaaagcaaucaucuucuucgaccccgacgccaaaggacugucagacccaggcaaaaucaaacgccuacgcucccagguucaagucucccuagaagacuauaucaacgaccgccaguacgacuccagaggccgauucggagaacuccuccuacuccuaccgacccuacaauccaucaccuggcaaaugaucgaacagauccaauucaucaaacuauucggaauggccaaaaucgacaaccuacuccaagaaaugcuucucggaggcuccccauccgacgccccccacgcccaccacccucuccacccccaccucaugcaggaacacaugggcaccaacgucaucgucgcaaacacuaugccuacccaccucuccaacggacaaaugugcgaauggccacgcccacgcggccaagccgccacacccgaaaccccacaaccauccccccccggcggaagcggcagcgaaccuuacaaacuccuacccggcgccgucgccacuauagucaaaccucucuccgccaucccacagcccaccaucaccaagcaagaagucaucuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2328 - RNA, 906 nt, Artificial Sequence
  mRNA product Design4 comprising derived and/or modified sequence from Homo sapiens__NP_061986.1__HsFGF21 (opt9)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2329 - RNA, 1632 nt, Artificial Sequence
  mRNA product Design4 comprising derived and/or modified sequence from Homo sapiens__NP_078852.3__HsOGFRL1 (opt9)
gggagagucccgcagucggcguccagcggcucugcuuguucgugugugugucguugcaggccuuauucaagcuuaccaugggcaaccuacuaggcggagucucauuccgcgaaccaaccaccguagaagacugcgacucaaccuggcaaaccgacuccgaaccagaaccggaggaacccggccccggcggagguagcgagggcccaggccaagaaagcgaacaaccagcccaaccacccgagcaagcaggaggacgccccggcgcaagccccgcacccgacgaagacgccgaagccgccggugccgaacaaggcggagacagcacagaagcaaccgcuaaacccaaacgcagcuucuacgcggcacgagaccuauacaaauaccggcaccaguacccaaacuucaaagacauccgauaccaaaacgaccucuccaaccucagauucuacaaaaacaagauccccuuuaaacccgacggagucuacaucgaagaaguauugagcaaauggaaaggcgacuacgaaaaacucgaacacaaccacacauacauacaauggcuauucccccuaagagaacaaggccugaacuucuacgcaaaagaacuaacaacauacgaaaucgaagaguucaaaaagacaaaagaagcaauccgcagauucuuacucgccuacaaaaugaugcuagaguucuucggcaucaaacuaacagacaaaacaggcaacgucgcccgagccgucaacuggcaggaacgcuuccaacaccucaacgaaucacaacacaacuaucuccggaucacccgaaucuuaaaaucacucggagaacuaggcuacgaaucguucaaaucaccccuaguuaaauucauccuccacgaagcccucguagaaaacaccauccccaacaucaaacaaagcgcgcuagaauacuucgucuacacaauccgcgaccgcagagaacgccgaaaacuacuccgcuucgcucagaaacacuacaccccaagcgaaaacuucaucuggggaccaccccgaaaagaacaauccgagggcuccaaagcccaaaagauguccagcccccucgcaucaucgcacaacagccaaaccucaaugcacaagaaagccaaagacuccaaaaacagcucaagcgccguccaccucaacagcaaaaccgcagaagacaagaaagucgccccaaaagaacccgucgaagagaccgaccgccccucacccgaacccagcaacgaagccgcaaaaccccgcaacaccgaaaaagacagcaacgccgaaaacaugaacucccaacccgagaaaaccguaacaacacccaccgaaaagaaagaaagcguauccccugaaaacaacgaagaaggaggaaacgacaaccaagacaacgaaaacccaggcaacacgaacugccacgacguaguccuaguacaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2330 - RNA, 834 nt, Artificial Sequence
  mRNA product Design4 comprising derived and/or modified sequence from Homo sapiens__NP_008842.1__HsRLN1 (opt9)
gggagagucccgcagucggcguccagcggcucugcuuguucgugugugugucguugcaggccuuauucaagcuuaccaugccccgccuauuccucuuccaccuccuagaauuuugccuccuccucaaccaauucucccgcgccgucgccgccaaauggaaagacgacgucaucaaacucugcggccgcgaacucguacgcgcccaaaucgccauaugcggcauguccaccuggucaaaacgcucccucucccaagaagacgccccccaaacaccccgaccagucgcagaaaucguccccuccuucaucaacaaagacacagaaaccaucaucaucaugcucgaauuuaucgcaaaccucccccccgaacucaaagccgcccucuccgaacgccaacccucacuccccgaacuccaacaauacguccccgcccucaaagacuccaaccuuuccuucgaagaauuuaaaaaacuaauccgaaaccgucaaucagaagccgccgacuccaaccccuccgaacucaaauaccuaggccuagacacccacucccaaaaaaaacgacgacccuacgucgcccucuucgaaaaaugcugccucaucggcugcacaaaacgcucccucgcaaaauacugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2331 - RNA, 834 nt, Artificial Sequence
  mRNA product Design4 comprising derived and/or modified sequence from Homo sapiens__NP_604390.1__HsRLN2 (opt9)
gggagagucccgcagucggcguccagcggcucugcuuguucgugugugugucguugcaggccuuauucaagcuuaccaugccccgccucuucuucuuccaccuccucggcgucugccuccuccuuaaccaguucucccgcgccguagccgacuccuggauggaagaagucaucaaacucugcggccgcgaacucguccgcgcacaaaucgccaucugcggaaugucaaccugguccaaacgcucacucucccaagaagacgccccccaaaccccccgcccugucgcagaaaucguccccuccuucaucaacaaagacaccgaaaccaucaacaugauguccgaauuugucgccaaccucccccaagaacucaaacucacccuaucagaaaugcaacccgcccuaccccaacuccaacagcacguacccguccucaaagacuccagccuccuauucgaagaauuuaaaaaacucauccgaaaccgacaauccgaagccgcagacucaucacccuccgaacuaaaauaucucggccucgacacccacucccgcaaaaaacgccaacucuacuccgcccucgccaacaaaugcugccacgucggcugcaccaaacgcucacucgcccgcuucugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2332 - RNA, 705 nt, Artificial Sequence
  mRNA product Design4 comprising derived and/or modified sequence from Homo sapiens__NP_543140.1__HsRLN3  (opt9)
gggagagucccgcagucggcguccagcggcucugcuuguucgugugugugucguugcaggccuuauucaagcuuaccauggcgcgcuacaugcugcuauugcuccuggccgugugggugcucacgggcgagcucuggcccggggcagaggcaagggcagcgcccuauggagugcgauugugcgggcgagaguucauacgcgcggucauauucacgugcgggggaucacgauggcgcaggagcgauaucuuggcccaugaagcgaugggggacacguucccggacgcggacgcggacgaggacucgcuagcgggcgaacucgaugaagcgauggggagcucggaauggcucgcgcucacgaaaucgccacaggccuuuuacaggggcaggcccucguggcagggcacgcccggggucuugcgcgggaguagggacgugcucgcgggauugagcucgagcuguugcaagugggggugcucgaaaucggaaauaagcucgcuauguugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2333 - RNA, 1686 nt, Artificial Sequence
  mRNA product Design4 comprising derived and/or modified sequence from Homo sapiens__NP_002412.1__HsMMP1 (opt9)
gggagagucccgcagucggcguccagcggcucugcuuguucgugugugugucguugcaggccuuauucaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2334 - RNA, 1446 nt, Artificial Sequence
  mRNA product Design4 comprising derived and/or modified sequence from Homo sapiens__NP_002412.1__HsMMP1(1-19,100-469) (opt9)
gggagagucccgcagucggcguccagcggcucugcuuguucgugugugugucguugcaggccuuauucaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2335 - RNA, 3633 nt, Artificial Sequence
  mRNA product Design4 comprising derived and/or modified sequence from Clostridium histolyticum__BAA77453.1__ColG (opt9)
gggagagucccgcagucggcguccagcggcucugcuuguucgugugugugucguugcaggccuuauucaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2336 - RNA, 3357 nt, Artificial Sequence
  mRNA product Design4 comprising derived and/or modified sequence from Clostridium histolyticum__BAA77453.1__HsALB(1-18)_ColG(111-1118) (opt9)
gggagagucccgcagucggcguccagcggcucugcuuguucgugugugugucguugcaggccuuauucaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2337 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt9)
gggagagucccgcagucggcguccagcggcucugcuuguucgugugugugucguugcaggccuuauucaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2338 - RNA, 3381 nt, Artificial Sequence
  mRNA product Design4 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2339 - RNA, 3342 nt, Artificial Sequence
  mRNA product Design4 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2340 - RNA, 3276 nt, Artificial Sequence
  mRNA product Design4 comprising derived and/or modified sequence from Clostridium histolyticum__BAA34542.1__HsALB(1-18)_ColH(41-1021) (opt9)
gggagagucccgcagucggcguccagcggcucugcuuguucgugugugugucguugcaggccuuauucaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2341 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt9)
gggagagucccgcagucggcguccagcggcucugcuuguucgugugugugucguugcaggccuuauucaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2342 - RNA, 1122 nt, Artificial Sequence
  mRNA product Design4 comprising derived and/or modified sequence from Homo sapiens__NP_003801.1__HsTNFSF10 (opt11)
gggagagucccgcagucggcguccagcggcucugcuuguucgugugugugucguugcaggccuuauucaagcuuaccauggcgaugauggaaguccaaggaggcccaucccucggccaaaccugcguccuaaucgucaucuucaccguccuacuacaaucccucugcgucgccgucaccuacgucuacuucaccaacgaacucaaacaaaugcaagacaaauacuccaaaagcggcaucgcaugcuuccuaaaagaagacgacucauacugggacccaaacgacgaagaaucaaugaacucccccugcuggcaagucaaauggcaacuacgacaacuuguccgcaaaaugauacuccgcaccucagaagagacaaucuccaccguccaagaaaaacaacaaaacaucagcccccucguccgagaacgcggaccccaacgagucgccgcacacaucaccggcacccgaggccgauccaacacacucagcucacccaacagcaaaaacgaaaaagcacucggccgcaaaauaaacucaugggaaucaucacguucaggccacuccuuccucuccaaccuacaccuccgcaacggcgagcuagucauccacgaaaaaggcuucuacuacaucuacucccaaaccuacuuucgauuccaagaagaaaucaaagaaaacacgaaaaacgacaaacagaugguccaauacaucuacaaauacaccagcuaccccgaccccauacuccucaugaaauccgcccgaaacuccugcuggagcaaagacgccgaauacggccucuacuccauauaccaaggcggcaucuucgaacucaaagaaaacgaccgcaucuucguaagcgucaccaacgaacaccucaucgacauggaccacgaagccuccuucuucggcgccuuccucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2343 - RNA, 843 nt, Artificial Sequence
  mRNA product Design4 comprising derived and/or modified sequence from Homo sapiens__NP_003801.1__HsTNFSF10(95-281) (opt11)
gggagagucccgcagucggcguccagcggcucugcuuguucgugugugugucguugcaggccuuauucaagcuuaccaugaccuccgaagaaaccaucucuacuguccaagaaaaacaacaaaacaucucaccccuaguccgcgaacgcggcccccaacgcgucgccgcccacaucaccggcacccgcggccgauccaacacccucuccucccccaauuccaaaaacgaaaaagcccucggccgcaaaaucaacuccugggaauccucccgcuccggccacuccuuccucuccaaccuccaccuccgcaacggcgaacucgucauccacgaaaaaggcuucuacuacaucuacucccaaaccuacuuccgcuuccaagaagaaaucaaagaaaacaccaaaaacgacaaacaaaugguccaguacaucuacaaauacaccuccuaccccgaccccauccuccucaugaaauccgcccgcaacagcugcugguccaaagacgccgaauacggccucuacuccaucuaccaaggcggcaucuucgaacucaaagaaaacgaccgaaucuucgucucagucaccaacgaacaccuaaucgacauggaccacgaagccuccuucuucggcgccuuccucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2344 - RNA, 894 nt, Artificial Sequence
  mRNA product Design4 comprising derived and/or modified sequence from Homo sapiens__NP_003801.1__HsALB(1-18)_HsTNFSF10(95-281) (opt11)
gggagagucccgcagucggcguccagcggcucugcuuguucgugugugugucguugcaggccuuauucaagcuuaccaugaaaugggucaccuucaucucccuccuauuccucuucuccuccgccuacuccaccuccgaagaaaccaucuccaccguccaagaaaaacaacaaaacaucucaccccuuguccgcgaacgcggcccccaacgcguagccgcccacaucaccggcacccgcggccgcuccaacacccucuccucccccaacuccaaaaacgaaaaagcccucggccgcaaaaucaacuccugggaauccucccgcuccggccacucauuccucuccaaccuccaccuccgaaacggcgaacucgucauccaugaaaaaggcuucuacuacaucuacucccaaaccuacuuccgcuuccaagaagaaaucaaagaaaacaccaaaaacgacaaacaaaugguccaauacaucuacaaauacaccuccuaccccgacccaauccuacuaaugaaauccgcccgcaacuccugcugguccaaagacgccgaauacggacucuacuccauauaccaaggcggcaucuucgaacucaaagaaaacgaccgcaucuucgucuccgucaccaacgaacaccucaucgacauggaccacgaagccuccuucuucggcgccuuccucgucggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2345 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt11)
gggagagucccgcagucggcguccagcggcucugcuuguucgugugugugucguugcaggccuuauucaagcuuaccaugaagugggugaccuucaucucgcuccuguuccuguucucaagcgcguacucgcgcaugaaacaaaucgaagacaagaucgaggaaauacucucaaaaauauaccacaucgagaacgagaucgcgcgcauaaagaagcuaauaggcgagaccucggaagagaccauaagcacaguccaggaaaagcaacagaacauaagcccgcucgugcgcgagcgcggaccccagcgcguggccgcgcacauaaccgggacccggggccgcaguaacacccugagcucgcccaacagcaagaacgagaaagcacuagggcgaaaaaucaauagcugggaaucgagcagaagcgggcacucauuccuauccaaccuccaccucaggaacggggaacuggucauacacgagaaaggguucuacuacauauacucccaaacauacuuccgauuccaagaagaaauaaaagagaacacgaaaaacgacaagcaaaugguccaguacauauacaaauacacaagcuaccccgaccccauacucuugaugaaaagcgcacgcaacagcugcuggucgaaagacgccgaguacgggcucuacagcauauaccagggcggaaucuucgaacugaaagagaacgaccgcaucuucgugagcguaaccaacgaacaccucauagacauggaccacgaagcgagcuucuucggggccuuccuagugggcuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2346 - RNA, 1353 nt, Artificial Sequence
  mRNA product Design4 comprising derived and/or modified sequence from Rattus norvegicus__NP_036656.1__RnCebpa (opt11)
gggagagucccgcagucggcguccagcggcucugcuuguucgugugugugucguugcaggccuuauucaagcuuaccauggaauccgcagacuucuacgaagccgaaccccgcccacccaugucaucccaccuccaaucaccaccccacgcacccucuaaugccgccuucggauucccccgcggcgccggacccgcacccccacccgcaccacccgccgcccccgaaccccucggaggaaucugcgaacacgaaaccagcaucgacaucucagccuacaucgaccccgccgcauucaacgacgaguuccucgccgaccuuuuccaacacuccagacaacaagaaaaagcaaaagccgcagccggacccgccggcggaggcggcgacuucgauuaccccggcgcccccgccggccccggcggcgcagucauguccgcaggagcccacggcccaccacccggcuacggcugcgccgccgcaggcuaccuagacggucgacuggaaccccucuacgaacgcgucggcgccccugcacuccgcccccucgucauaaaacaagaaccccgagaagaagacgaagccaaacaacucgcccucgccggccuauuccccuaccaaccacccccaccacccccacccccacacccacacgccucaccagcacaccuugccgcaccccaccuacaauuccaaaucgcccacugcggccaaacaacaaugcaccuacaaccuggccaccccaccccaccucccacacccguccccucaccccauccugcccccgccaugggagcagcaggccuacccggaccaggcggcucccuaaaaggccuagccggcccacaccccgaccuacgaacuggcggaggcggcggaggcggcgcaggcgcaggcaaagccaagaaauccgucgacaaaaacuccaacgaauaucgcguccgccgagaacgcaacaacauagccguccgcaaaucccgugacaaagccaaacaacgaaacguagaaacucaacaaaaaguccucgaacucacauccgacaacgaccgccucagaaaacgcgucgaacaacucucccgagaacucgacacccuccgcggcaucuuccgccaacuccccgaaucaucccucgucaaagcaaugggcaacugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2347 - RNA, 1311 nt, Artificial Sequence
  mRNA product Design4 comprising derived and/or modified sequence from Rattus norvegicus__NP_036656.1__RnCebpa(15-344) (opt11)
gggagagucccgcagucggcguccagcggcucugcuuguucgugugugugucguugcaggccuuauucaagcuuaccaugucaucccaccuucaauccccaccccacgcccccuccaacgccgcauucggauucccccgaggagccggcccagcaccaccccccgccccaccagccgcccccgaaccccucggcggaauaugcgaacacgaaaccucaaucgacaucucagcguacauagacccagccgccuucaacgacgaauuccuagcggaccucuuccaacacuccagacaacaagaaaaagcaaaagccgccgccggacccgccggagguggaggagacuucgacuaccccggagcccccgccggacccggcggcgcaguaauguccgccggcgcacacggucccccccccggauacggcugcgcugccgccggcuaccuagacggcagacuagaaccacuauacgaacgcgucggcgccccagcccucagaccacuagucaucaaacaagaaccccgagaagaagacgaagcaaaacaacuagcccuagccggccuauuccccuaccaaccaccccccccaccaccccccccccacccccacgcaucccccgcccaccuagccgccccccaccuccaauuccaaauagcccacugcggccaaacaaccaugcaccuacaacccggacaccccacacccccccccacccccguccccucaccccaccccgcacccgccaugggcgccgccggccuccccggacccggcggcucccuaaaaggacuagccgguccccaccccgaccuccgcaccgggggaggaggcggcggcggcgccggagccggcaaagccaaaaaauccguugacaaaaacucaaacgaauacagagucagacgagaacgcaacaacauugccguccgcaaaucacgcgacaaagcaaaacaacgaaacgucgaaacacaacaaaaaguccucgaacucacuuccgacaacgaccgacuacgcaaacgcgucgaacaacucagccgcgaacucgacacacuccgcggcaucuuccgccaacuacccgaauccucccucguaaaagccaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2348 - RNA, 1356 nt, Artificial Sequence
  mRNA product Design4 comprising derived and/or modified sequence from Mus musculus__NP_031704.2 __MmCebpa (opt11)
gggagagucccgcagucggcguccagcggcucugcuuguucgugugugugucguugcaggccuuauucaagcuuaccauggaaucagccgacuucuacgaagucgaaccacgccccccaaugucuucccaccuacaaucuccgccccacgcucccucaaacgcagccuucggcuucccacgcggcgccggacccgcccccccacccgccccucccgccgcacccgaaccccucggcggcaucugcgaacacgaaacauccaucgacauaagcgcauacauagaccccgcagcauucaacgacgaauuccucgccgaccucuuccaacacucgcgucaacaagaaaaagcaaaagccgcagccggccccgccggcggcggcggcgacuucgacuaccccggcgcccccgccggucccggaggagccguaaugucggcaggcgcccacggacccccccccggauacggaugcgccgccgccggcuaccuagacggacgccucgaaccccucuacgaaagagucggagcacccgcccuacgcccucucguaaucaaacaagaaccccgcgaagaagacgaagccaaacaacucgcccuagccggacucuuccccuaccaacccccccccccaccacccccaccccacccccacgcaucaccagcccaccuagccgccccccaccuacaauuccaaauagcacacugcggacaaaccaccaugcaccugcaaccaggacacccaacccccccacccaccccaguccccuccccccacgccgcccccgcacucggagccgccggccuacccggccccggcucagcacucaaaggccuugcaggcgcccacccagaccuacguacaggcggaggaggcggcggcuccggcgccggcgccggaaaagccaaaaaauccgucgacaaaaacuccaacgaauaccgcguccgccgcgaacgaaacaacaucgccgucagaaaaucccgcgacaaagcaaaacaacgcaacgucgaaacccaacaaaaaguccuagaauuaaccuccgacaacgacagacuucgcaaacgagucgaacaacuaucacgcgaacucgacacacuccgcggcauauuccgccaacucccagaaucaucccuugucaaagccaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2349 - RNA, 1314 nt, Artificial Sequence
  mRNA product Design4 comprising derived and/or modified sequence from Mus musculus__NP_031704.2 __MmCebpa(15-359) (opt11)
gggagagucccgcagucggcguccagcggcucugcuuguucgugugugugucguugcaggccuuauucaagcuuaccaugucaucccaccuccaauccccaccccacgccccauccaacgcugccuucggauucccccgcggcgccggccccgcacccccacccgccccccccgcugcaccagaacccuuaggcggaauaugcgaacacgaaaccagcauagacaucucagcauacauugaccccgccgccuucaacgacgaauuccucgccgaccucuuccaacacagccgacaacaagaaaaagcaaaagccgcugcaggccccgccggcggcggcggcgacuucgacuaccccggcgccccagccggcccaggcggcgccgucaugucugcaggcgcccacggccccccacccggauacggaugugccgccgccggcuaucucgacggccgccuagaaccacucuacgaaagaguaggcgcccccgcccuccgcccccucgucaucaaacaagaacccagagaagaagacgaagccaaacaacucgcacucgccggccuguuccccuaccaaccccccccacccccaccccccccccacccacacgccucaccagcccaccucgccgccccccaccuccaauuccaaauagcccacugcggccaaaccaccaugcaccuccaaccgggccaccccaccccccccccaacccccguccccucuccccacgcagccccagcauuaggcgccgccggacuaccaggcccaggaucagcccuaaaaggacuagcaggcgcacaccccgaccuccgcacaggcggaggcggaggcggcagcggagccggcgccggaaaagccaaaaaaucagucgauaaaaacucaaacgaauacagaguccgacgcgaacgcaacaacaucgccguccgcaaaucaagagacaaagcuaaacaacgcaacguggaaacucaacaaaaaguccucgaacucaccucagacaacgaccgccuccgcaaacgcgucgaacaacucuccagagaacucgacacccuccgcggaaucuuucgacaacuccccgaauccucacucguaaaagcaaugggcaauugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2350 - RNA, 1353 nt, Artificial Sequence
  mRNA product Design4 comprising derived and/or modified sequence from Homo sapiens__NP_004355.2__HsCEBPA (opt11)
gggagagucccgcagucggcguccagcggcucugcuuguucgugugugugucguugcaggccuuauucaagcuuaccauggaaagcgcagacuucuacgaagcagaaccccgaccccccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2351 - RNA, 1311 nt, Artificial Sequence
  mRNA product Design4 comprising derived and/or modified sequence from Homo sapiens__NP_004355.2__HsCEBPA(15-358) (opt11)
gggagagucccgcagucggcguccagcggcucugcuuguucgugugugugucguugcaggccuuauucaagcuuaccaugucaucucaccuacaaucccccccacacgcccccuccuccgccgccuucggcuucccccgcggugccggccccgcucaaccccccgccccacccgcagcaccagaaccccuaggcggcaucugcgaacacgaaaccuccaucgacauauccgccuacaucgacccagcagccuucaacgacgaauuucucgccgaccuauuccaacacucccgccaacaagaaaaagccaaagcagcagucggaccaaccggcgguggaggaggcggcgacuucgacuaccccggcgcccccgcaggaccaggcggagcagucaugcccggaggagcccacggccccccccccggcuacggcugcgcagccgcaggcuaccucgacggacgucucgaaccccucuacgaacgcgucggagccccagcccuaagaccccuagucaucaaacaagaaccccgcgaagaagacgaagccaaacaacucgcccucgccggcuuauuccccuaccagcccccccccccaccaccccccucacacccccacccacaucccccccccgcccaccucgccgccccccaccuccaauuccaaaucgcacacugcggccaaacaacaaugcaccuacaacccggacaccccacaccuccccccacccccguacccucaccccaccccgcucccgcacucggcgcagccggccugcccggccccgguuccgcccucaaaggccuaggcgcagcacaccccgaccucagagccucaggcggcuccggcgcaggcaaagccaaaaaauccguugacaaaaacuccaaugaauaccgaguccgucgagaacgcaacaacaucgcaguccgcaaauccagagacaaagccaaacaacgcaacgucgaaacccaacaaaaaguccucgaacucaccuccgacaacgaccgccuccgaaaacgcgucgaacaacucucacgagaacucgacacacuccgcgguaucuuccgucaacucccagaauccuccuuagucaaagccaugggcaacugcgccuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2352 - RNA, 1701 nt, Artificial Sequence
  mRNA product Design4 comprising derived and/or modified sequence from Homo sapiens__NP_000448.3__HsHNF4A (opt11)
gggagagucccgcagucggcguccagcggcucugcuuguucgugugugugucguugcaggccuuauucaagcuuaccaugcgucuuuccaaaacacucguagacauggacauggcagacuacagcgccgcccucgacccagccuacaccacccucgaauuugaaaacguccaaguccuaacuaugggaaacgacacaucacccucagaagguacaaaccucaacgcccccaacucgcuaggcgucuccgcacuaugcgcaaucugcggcgaccgugccaccggcaaacacuacggagccucauccugcgacgguuguaaaggcuucuuccgacgcagcgucagaaaaaaccacauguacuccugccgcuucucccgucaaugcgucgucgacaaagacaaacgcaaccaaugccgguacugccgccuaaaaaaaugcuuccgcgcaggcaugaaaaaagaagcaguccaaaacgaacgcgaccgcauaucaacccgucgaucaucauacgaagacuccucccuccccagcaucaacgcccuccuccaagcagaaguacuaagccggcaaauaacauccccagucagcggcaucaacggagacauacgagccaaaaaaauagcuucaaucgccgacgucugcgaauccaugaaagagcaacuacugguccucgucgaaugggcuaaauacaucccggccuucugcgaacucccccucgacgaucaagucgcccuucuaagagcccacgccggcgaacaccuccucuuaggcgcaaccaaacgcagcaugguauucaaagacguacugcuccucggcaacgauuacaucgucccacgacauugccccgagcucgcagaaaugucccgagucuccauccgcauacucgacgaacucguacuccccuuccaagaacuccaaauagacgacaaugaauacgcauaccucaaagcaaucaucuucuucgaccccgacgccaaaggacucagcgacccaggcaaaaucaaacgccuacgaucacaaguacaaguuucacuugaagacuacaucaacgacagacaauacgacucaagaggucguuucggagaacuacuccuacuacuaccaacccuccaaagcauaaccuggcaaaugauagaacaaauacaauuuauaaaacucuucggcauggccaaaaucgacaaucuccuacaagaaaugcuccucggaggaagccccucagaugccccacacgcccaccacccacuacacccccaccucaugcaagagcacauggguaccaacgucauagucgccaacacaaugcccacccaccucucaaacggccaaaugugcgaauggccgcgcccacgcggacaagccgccacccccgaaaccccacagccaagcccacccgguggcuccggcagcgaacccuacaaacuccuacccggcgccguugcaacaauagucaaaccccuauccgccauaccccaaccaacgaucaccaaacaagaagucaucuagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2353 - RNA, 906 nt, Artificial Sequence
  mRNA product Design4 comprising derived and/or modified sequence from Homo sapiens__NP_061986.1__HsFGF21 (opt11)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2354 - RNA, 1632 nt, Artificial Sequence
  mRNA product Design4 comprising derived and/or modified sequence from Homo sapiens__NP_078852.3__HsOGFRL1 (opt11)
gggagagucccgcagucggcguccagcggcucugcuuguucgugugugugucguugcaggccuuauucaagcuuaccaugggcaaccuccuaggcggagucucauuccgcgaacccaccacaguagaagacugcgacuccaccuggcaaacagacuccgaacccgaaccagaggaaccuggacccggcggcggaucggaaggacccggccaagaaagcgagcagcccgcacaaccacccgaacaagccgguggacgcccaggcgccucacccgccccagacgaggacgccgaagccgccggcgcagagcagggcggagacagcacugaagccacagcaaaaccuaaacgcuccuucuacgccgcccgagaccucuacaaauacagacaccaauaccccaacuucaaagacauucgauaccaaaacgaccucuccaaccuccgcuucuacaaaaacaaaaucccauucaaacccgacggagucuacauagaagaaguccucuccaaauggaaaggcgacuacgaaaaacuggaacacaaccacacauacauccaauggcucuuuccccuccgcgaacaaggccucaacuucuacgccaaagaacuaaccacauacgagaucgaagaauuuaaaaaaacuaaagaagccauacgccgcuuccuacucgccuacaaaaugaugcuagaguucuucggcaucaaacucaccgacaaaaccggcaacgucgcccgagccgucaacuggcaagaacgauuccaacaccucaacgaaucccaacacaacuaccuacgcauaacccgcauacuaaaaucccuuggcgaacucggauacgaauccuucaaauccccacuugucaaguucauccuccacgaagcucuagucgaaaacacaauaccaaacauaaaacaguccgcacucgaauacuucgucuacaccauccgcgaccgccgcgagcgccgcaaacuccuccgcuucgcccagaaacacuacacccccuccgaaaacuucaucuggggacccccaagaaaagaacaaucagaaggaucaaaagcucaaaagaugagcuccccacuagccucaucacacaacucccaaaccuccaugcacaaaaaagccaaagacucaaaaaauuccagcucagccguccaccucaacucaaaaaccgcagaggacaaaaaagucgcacccaaagaacccguagaagaaaccgaccgaccaucacccgaaccauccaacgaagcagccaaaccacgcaacacagagaaagacuccaacgccgaaaacaugaacucccaacccgaaaaaacagugaccacacccaccgaaaaaaaagaauccguaucccccgaaaacaacgaggaaggcggaaacgacaaccaagacaacgaaaaccccggcaacaccaacugccaugacgucguccuaguccaauagggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2355 - RNA, 834 nt, Artificial Sequence
  mRNA product Design4 comprising derived and/or modified sequence from Homo sapiens__NP_008842.1__HsRLN1 (opt11)
gggagagucccgcagucggcguccagcggcucugcuuguucgugugugugucguugcaggccuuauucaagcuuaccaugccccgccucuuccucuuccaccuccuagaauuuugccuccuccucaaccaauucucccgcgccgucgccgccaaauggaaagacgacgucaucaaacucugcggccgcgaacucguccgcgcccaaaucgccaucugcggcauguccaccugguccaaacguucccucucacaagaagacgccccccaaaccccccgccccgucgccgagaucguccccuccuucaucaacaaagacaccgaaaccaucaucaucaugcucgaauuuaucgccaaccucccccccgaacucaaagccgcccucuccgaacgccaacccucccuccccgaacuccaacaauacguccccgcccucaaagacuccaaccucuccuucgaagaauuuaaaaaacucauccgcaaccgccaauccgaagccgccgacuccaaccccuccgaacucaaauaccucggacucgacacccacucccaaaaaaaacgccgaccuuacgucgcccucuucgaaaaaugcugccuaaucggcugcaccaaacgcucccucgccaaauacugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2356 - RNA, 834 nt, Artificial Sequence
  mRNA product Design4 comprising derived and/or modified sequence from Homo sapiens__NP_604390.1__HsRLN2 (opt11)
gggagagucccgcagucggcguccagcggcucugcuuguucgugugugugucguugcaggccuuauucaagcuuaccaugccccgccucuucuucuuccaccuccucggcgucugccuccuccuaaaccaauucucccgagccgucgccgacuccuggauggaagaagucaucaaacuaugcggccgcgaacucguccgcgcccaaaucgccaucugcggcauguccaccugguccaaacgcucccucucccaagaagacgccccccaaaccccccgccccgucgccgaaaucguccccuccuucaucaauaaagacaccgaaaccauaaacaugauguccgaauuugucgcaaaccucccccaagaacucaaacucacccucuccgaaaugcaacccgcccucccccaacuacaacaacacguccccguccucaaagacuccucccuacucuucgaagaauuuaaaaaacucauccgcaaccgccaaucagaagccgccgacuccuccccauccgaacucaaauaccucggccucgacacccacucccgaaaaaaacgccaacucuacagcgcccucgccaacaaaugcugccacgucggcugcaccaaacgcucccucgcccgcuucugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2357 - RNA, 705 nt, Artificial Sequence; identical to SEQ ID NO: 2072
  mRNA product Design4 comprising derived and/or modified sequence from Homo sapiens__NP_543140.1__HsRLN3  (opt11)

SEQ ID NO: 2358 - RNA, 1686 nt, Artificial Sequence
  mRNA product Design4 comprising derived and/or modified sequence from Homo sapiens__NP_002412.1__HsMMP1 (opt11)
gggagagucccgcagucggcguccagcggcucugcuuguucgugugugugucguugcaggccuuauucaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2359 - RNA, 1446 nt, Artificial Sequence
  mRNA product Design4 comprising derived and/or modified sequence from Homo sapiens__NP_002412.1__HsMMP1(1-19,100-469) (opt11)
gggagagucccgcagucggcguccagcggcucugcuuguucgugugugugucguugcaggccuuauucaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2360 - RNA, 3633 nt, Artificial Sequence
  mRNA product Design4 comprising derived and/or modified sequence from Clostridium histolyticum__BAA77453.1__ColG (opt11)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2361 - RNA, 3357 nt, Artificial Sequence
  mRNA product Design4 comprising derived and/or modified sequence from Clostridium histolyticum__BAA77453.1__HsALB(1-18)_ColG(111-1118) (opt11)
gggagagucccgcagucggcguccagcggcucugcuuguucgugugugugucguugcaggccuuauucaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2362 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt11)
gggagagucccgcagucggcguccagcggcucugcuuguucgugugugugucguugcaggccuuauucaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2363 - RNA, 3381 nt, Artificial Sequence; identical to SEQ ID NO: 2138
  mRNA product Design4 comprising derived and/or modified sequence from Clostridium histolyticum__BAA34542.1__ColH (opt11)

SEQ ID NO: 2364 - RNA, 3342 nt, Artificial Sequence; identical to SEQ ID NO: 2074
  mRNA product Design4 comprising derived and/or modified sequence from Clostridium histolyticum__BAA34542.1__ColH (opt11)

SEQ ID NO: 2365 - RNA, 3276 nt, Artificial Sequence
  mRNA product Design4 comprising derived and/or modified sequence from Clostridium histolyticum__BAA34542.1__HsALB(1-18)_ColH(41-1021) (opt11)
gggagagucccgcagucggcguccagcggcucugcuuguucgugugugugucguugcaggccuuauucaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2366 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt11)
gggagagucccgcagucggcguccagcggcucugcuuguucgugugugugucguugcaggccuuauucaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2367 - RNA, 1122 nt, Artificial Sequence
  mRNA product Design4 comprising derived and/or modified sequence from Homo sapiens__NP_003801.1__HsTNFSF10 (opt12)
gggagagucccgcagucggcguccagcggcucugcuuguucgugugugugucguugcaggccuuauucaagcuuaccauggcaaugauggaaguacaaggaggacccagccuaggacaaacaugcguacuaauaguaauauucacaguacuacuacaaucacuuugcguugcaguaacauacguauacuucacaaacgaacuaaaacaaaugcaagacaaauacucaaaaucaggaauagcaugcuucuuaaaagaagaugacucuuacugggacccaaacgacgaagaaagcaugaauagccccugcuggcaaguaaaauggcaacuaagacaacucguacgaaaaaugauacuacgaacaucagaagaaacaauaucaacaguacaagaaaaacaacaaaacauauccccauuaguaagagaaagaggaccacaaagaguagcagcacacauaacaggaacaagaggaagaucaaacacacuaucaaguccaaacaguaaaaacgaaaaagcacuaggaagaaaaauaaacagcugggaaaguaguagaucaggacacucauuccuaucaaaccuacaccuaagaaacggagaauuaguaauccaugaaaaaggauucuacuacauauacucacaaacauauuucagauuccaagaagaaauaaaagaaaauacuaaaaacgacaaacaaaugguccaauauauauacaaauauacaucauacccagacccaauacuacuaaugaaaucagcaagaaacucaugcuggucaaaagaugcagaauauggacuauacucaauauaccaaggaggaauauucgaacuaaaagaaaaugacagaauauuuguaucaguaacaaacgaacaccuaauagacauggaccacgaagcaucauuuuucggcgccuuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2368 - RNA, 843 nt, Artificial Sequence
  mRNA product Design4 comprising derived and/or modified sequence from Homo sapiens__NP_003801.1__HsTNFSF10(95-281) (opt12)
gggagagucccgcagucggcguccagcggcucugcuuguucgugugugugucguugcaggccuuauucaagcuuaccaugacaucagaagaaacaauaagcacaguacaagaaaaacaacaaaacauaucaccacuuguaagagaaagaggaccacaaagaguagcagcacacauaacaggaacaagaggaagaucaaacacacuaagcucaccaaacucaaaaaacgaaaaagcacuaggaagaaaaauaaacucaugggaaucaagcagaucaggacacucauuccuaucaaaccuacaccuaagaaacggagaacuuguaauacacgaaaaaggauucuacuacauauacucacaaacauacuucagauuccaagaagaaauaaaagaaaacacaaaaaacgacaaacaaaugguacaauacauauacaaauacacaucauacccagacccaauacuacuaaugaaaagcgcaagaaacagcuguuggucaaaagaugcagaauacggacuauacucaauauaccaaggaggaaucuucgaauuaaaagaaaacgacagaauauucguaucaguaacaaacgaacaccuaauagacauggaccacgaagcaucauucuucggagcauuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2369 - RNA, 894 nt, Artificial Sequence
  mRNA product Design4 comprising derived and/or modified sequence from Homo sapiens__NP_003801.1__HsALB(1-18)_HsTNFSF10(95-281) (opt12)
gggagagucccgcagucggcguccagcggcucugcuuguucgugugugugucguugcaggccuuauucaagcuuaccaugaaauggguaacauucauaucacuacuauuccuauucucaagcgcauacucaacaucagaagaaacaauaucaacaguacaagaaaaacaacaaaacauaucaccauuaguaagagaaagaggaccacaaagaguagcagcacacauaacaggaacaagaggaagaagcaacacacuaagcucaccaaacaguaaaaacgaaaaagcacuaggaagaaaaauaaacucaugggaaucaucaagaucaggacacucauuccuaucaaaccuacaccuaagaaacggagaauuaguaauacacgaaaaaggauucuacuauauauacucacaaacauacuucagauuccaagaagaaauaaaagaaaacaccaaaaacgacaaacaaaugguacaauacauauacaaauacacaucauacccagacccaauacuacuaaugaaaagcgcaagaaacucaugcuggucaaaagacgcagaauacggacuauacagcauauaccaaggaggaauauucgaacuaaaagaaaacgacagaauauucguaucagucacaaacgaacacuuaauagacauggaccacgaagcaucauucuucggagcauucuuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2370 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt12)
gggagagucccgcagucggcguccagcggcucugcuuguucgugugugugucguugcaggccuuauucaagcuuaccaugaaauggguaacauucauaucgcuacuauucuuauucucaagcgcauacucaagaaugaaacaaauagaagacaaaauagaagaaauacucucaaaaauauaccauaucgaaaacgaaauagcaagaauaaaaaaacuaauaggcgaaacuucagaagaaacaauaagcacaguacaagaaaaacaacaaaacauaagcccacuuguaagagaaagaggaccacaaagaguagcagcacauauaacaggaacaagaggaagaagcaacacacuaagcucaccaaacaguaaaaacgaaaaagcacuuggacgaaaaauaaauagcugggaaucaucaagaagcggacacucguuccuaagcaaccuacaccuaagaaacggagaacuuguaauacacgaaaaaggauucuacuacauauacucacaaacauauuuuagauuccaagaagaaauaaaagaaaacacaaaaaacgacaaacaaaugguacaauacauauacaaauacacaucauacccagacccaauacuccuaaugaaaagcgcaagaaacagcugcuggucaaaagaugcagaauacggacuauacagcauauaccaaggaggaauauuugaacuaaaagaaaacgauagaauauucguaaguguaacaaacgaacaccuaauagacauggaccacgaagcuagcuucuucggagcauuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2371 - RNA, 1353 nt, Artificial Sequence
  mRNA product Design4 comprising derived and/or modified sequence from Rattus norvegicus__NP_036656.1__RnCebpa (opt12)
gggagagucccgcagucggcguccagcggcucugcuuguucgugugugugucguugcaggccuuauucaagcuuaccauggaaucagcagacuuuuaugaagcugaaccaagaccccccaugucaucccacuuacaaucacccccacaugcuccaucaaacgcagcauuuggauucccaaggggagcaggcccugcaccaccaccagcaccaccagcagcaccagaaccauuaggagguauuugugaacacgaaacaucaauagacauauccgcuuauauagauccagcagcauuuaaugaugaauuucuagcagaucuuuuucaacauaguagacaacaagaaaaagcaaaagcagcagcugguccagcuggaggaggaggagacuucgauuauccaggagcaccugcagggccuggaggagcggucaugagugcaggugcacauggaccaccuccaggauauggaugugcagcagccggauauuuagauggaagacuagaaccauuauaugaaagaguaggcgcaccagcauuaagaccauuaguaauaaaacaagaaccaagagaagaagacgaagcaaaacaauuagcacuagcaggacuauucccauaucaaccuccaccuccaccaccaccaccacacccacaugcaucaccagcacauuuagcagcaccacauuuacaauuucaaauugcacauuguggacaaacaacaaugcauuuacaaccaggacauccaacaccaccaccaacaccaguaccuucaccacauccagcaccagcaaugggcgcagcagguuuaccaggaccaggaggaaguuuaaaaggcuuagcugguccucauccagaccuaagaaccggaggaggaggaggaggaggagcaggagcaggaaaagcaaaaaaaaguguagauaaaaauucaaaugaauauagaguaagaagagaaagaaacaauauagcaguaagaaaaucuagagauaaagcgaaacaaagaaauguagaaacacaacaaaaaguguuagaacuaacaucagacaacgauagauuaagaaaaagaguagaacaauuaucgagagaacuugauacccuacgaggaauauuucgacaauuaccugaaucaucauuaguaaaagcaauggguaauugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2372 - RNA, 1311 nt, Artificial Sequence
  mRNA product Design4 comprising derived and/or modified sequence from Rattus norvegicus__NP_036656.1__RnCebpa(15-344) (opt12)
gggagagucccgcagucggcguccagcggcucugcuuguucgugugugugucguugcaggccuuauucaagcuuaccaugucaucacaucuacaaucaccaccucaugcaccuucaaaugcagccuuuggauucccaagaggagcaggaccagcaccaccaccagcaccaccagcagcaccagaaccauuaggaggaauaugcgaacaugaaacaucaaucgauauauccgcauauauagauccagcagcauucaaugaugaauuuuuagcagauuuauuucaacauagucgacaacaagaaaaagcaaaagcagcagcaggcccagcaggcggcggaggagacuuugauuacccuggagcaccagcuggacccggaggagcaguaaugucagcaggagcacaugguccaccaccaggauauggaugcgcagcagcaggauacuuagauggaagacuagaaccauuauaugaaagaguaggagcaccugcauuaagaccauuaguuaucaaacaagaaccaagagaagaagaugaagcaaaacaauuagcauuagcaggacuauuuccauaucaaccaccaccaccaccaccaccaccacauccacaugcaucaccagcucaucuagcagcaccucauuuacaauuucaaauagcacauuguggucaaacaacaaugcaucuacaaccaggacauccaacaccaccaccaacuccaguuccaucaccacauccagcaccagcaaugggagcagcaggacuaccaggaccaggaggaucauuaaaaggacuagcaggaccacauccugaucuaaggacaggcggcggaggaggaggaggugcaggagcuggaaaagcuaaaaaaucaguagauaaaaauucaaacgaauauagaguaagacgcgaaagaaauaauauugcgguacgaaaaucaagagauaaagcaaaacaacgaaauguagaaacacaacaaaaaguacuagaauuaacaagugauaacgaccgucuaagaaaaagaguagaacaacuaucaagagaauuagauacucuaagagguaucuuuagacaacuaccagaaucaucauuaguuaaagcaaugggaaacugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2373 - RNA, 1356 nt, Artificial Sequence
  mRNA product Design4 comprising derived and/or modified sequence from Mus musculus__NP_031704.2 __MmCebpa (opt12)
gggagagucccgcagucggcguccagcggcucugcuuguucgugugugugucguugcaggccuuauucaagcuuaccauggaaucagcagacuuuuaugaaguagaaccuagaccaccaaugaguucacauuuacaaucaccaccacaugcuccaucaaaugcagccuuuggauuuccuagaggagcaggaccagcaccaccaccagcuccaccagcugcaccagaaccauuaggaggaauaugugaacaugaaacaucaauagauauaucagcauacauagacccagcugcauuuaaugacgaauuucuagcugaucuuuuccaacacucaagacaacaagaaaaagcaaaagcagcagcuggaccagcaggaggaggaggagauuuugauuauccuggagcaccagcaggaccuggaggagcaguaaugucagcuggugcacauggaccuccaccaggauacgguugugcagcagcaggcuacuuagacggacgauuagaaccauuauacgaaagaguaggcgcuccagcacuuagaccuuuagucauuaaacaggaaccaagagaagaagaugaagcaaaacaacuagcuuuagcaggacuauuuccauaucaaccacccccaccaccaccaccuccacacccacaugcaucaccugcacaucuagcugcaccacauuuacaauuccaaauagcacauuguggucaaacaaccaugcauuuacaacccggacauccaaccccaccuccaacacccguuccuucuccacaugcagcaccagcacuaggagcagcagguuuaccaggacccggaagugcauuaaaaggauuagcaggagcacauccagauuuaagaacuggcgguggugguggaggaaguggagcuggugcaggaaaagccaaaaaaucaguagauaaaaauucuaacgaauauagaguaagaagagaaagaaauaauauugcuguaagaaaaucaagagauaaagccaaacaaagaaauguagaaacacaacaaaaaguauuagaauuaacaagcgauaaugauagguuaagaaaaagaguagaacaacugucuagagaauuagauacauuaagaggaauauuuagacaacuaccagaauccucacuaguaaaagcaaugggcaauugcgcuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2374 - RNA, 1314 nt, Artificial Sequence
  mRNA product Design4 comprising derived and/or modified sequence from Mus musculus__NP_031704.2 __MmCebpa(15-359) (opt12)
gggagagucccgcagucggcguccagcggcucugcuuguucgugugugugucguugcaggccuuauucaagcuuaccaugaguagccacuuacaaucaccaccacaugcaccaucaaaugccgcauuuggauucccacgaggugcagguccagcaccaccuccagcaccaccagcagcaccagaaccauuaggaggaauuugugaacaugaaacaucaauagauauuucagcauauauagauccugcagcauuuaaugaugaauuuuuagcagauuuauuucaacauaguagacaacaagaaaaagcaaaagcagcugcuggcccagcaggaggaggcggagauuucgauuauccuggagcaccagcaggaccuggaggagcaguaaugagugcaggugcacacggaccacccccaggauauggaugugcagcagcaggauacuuagaugguagauuagaaccauuauaugaaaggguaggugcaccagcacuaagaccauuaguaauaaaacaagaaccaagagaagaagacgaagcaaaacaauuagcauuagcuggauuauuucccuaccaaccacccccaccaccaccuccaccacacccacaugcuucaccagcucauuuagcagcaccucauuuacaauuucaaauagcucauugcggacaaacaacaaugcaucuacaaccaggacauccaacaccaccuccaacaccaguaccaucaccucaugcugcaccagcacuaggugcagcuggauuacccggaccaggaucagcauuaaaaggauuagcaggagcucauccagauuuaagaacagguggaggagguggugguucuggagcaggagcagguaaagcaaaaaaaaguguagauaaaaauaguaacgaauacagaguaagaagagaacgaaauaauauagcaguuagaaaaucaagagauaaagcaaaacaaagaaauguagaaacacaacaaaaaguccuagaauuaacaucagauaaugacagauuaagaaaaagaguagaacaauuaucacgagaacuugauacauuaagaggaauauuuagacaauuaccugaauccucucuaguaaaagcaaugggaaauugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2375 - RNA, 1353 nt, Artificial Sequence
  mRNA product Design4 comprising derived and/or modified sequence from Homo sapiens__NP_004355.2__HsCEBPA (opt12)
gggagagucccgcagucggcguccagcggcucugcuuguucgugugugugucguugcaggccuuauucaagcuuaccauggaaagcgcugauuuuuaugaagcagaaccaagaccaccaaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2376 - RNA, 1311 nt, Artificial Sequence
  mRNA product Design4 comprising derived and/or modified sequence from Homo sapiens__NP_004355.2__HsCEBPA(15-358) (opt12)
gggagagucccgcagucggcguccagcggcucugcuuguucgugugugugucguugcaggccuuauucaagcuuaccaugagcagccauuuacaaagcccaccacaugcaccaucuucugcugcauuuggauucccaagaggagcaggaccagcacaaccaccagcaccgccagcagcacccgaaccacuaggaggaauaugcgaacaugaaacaucuauagauauaucagcauauauagauccagcagcuuuuaaugaugaauuucuagcagauuuauuucaacauucaagacaacaagaaaaagcaaaagcagcaguaggaccaacaggaggaggaggaggaggagauuuugauuacccuggugcuccugcuggacccggaggagcaguaaugccaggaggugcucacggaccuccaccuggauacggaugugcagcagcaggcuaucuagacggaagacucgaaccacuauaugaaagaguaggagcuccugcauuaagaccauuaguuauuaaacaagaaccaagagaagaagaugaagcaaaacaauuagcauuagcaggauuauuuccauaucaaccaccaccaccaccaccacccucccauccacauccacaucccccaccagcucauuuagcagcaccacauuuacaauuucaaauagcucacuguggacaaacaacaaugcacuuacaaccuggacauccaacaccuccaccaacaccaguaccaaguccacauccagcaccagcauuaggagcagcaggacuaccaggcccaggaagugcacuaaaaggauuaggugcugcacauccagaccucagagccucaggaggaagcggagcuggaaaagcaaaaaaaucaguugauaaaaacucaaaugaauauagaguaagaagagaacgaaacaacauagcaguacgaaaaucaagagauaaagcaaaacaaaggaacguagaaacacaacaaaaaguauuagaauuaacaucagauaacgauagauuaagaaaacgaguagaacaacuauccagagaauuagauacauuaagaggaauauuuagacaauuaccagaaucuucauuaguuaaagcaaugggaaauugugcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2377 - RNA, 1701 nt, Artificial Sequence
  mRNA product Design4 comprising derived and/or modified sequence from Homo sapiens__NP_000448.3__HsHNF4A (opt12)
gggagagucccgcagucggcguccagcggcucugcuuguucgugugugugucguugcaggccuuauucaagcuuaccaugagacuaucaaaaacauuagucgacauggauauggcagacuacuccgcugcauuagauccagcauacacaacacuugaauuugaaaacguacaaguacuaacgaugggaaacgacaccucaccaagcgaaggaaccaauuuaaacgcacccaauucauuaggaguuucagcauuaugcgcaauaugcggagauagagcaacagggaaacauuauggagccucaaguugcgacggauguaaagguuucuucagaagaucaguaagaaaaaaccacauguacucaugcagauuuucuagacaaugcguaguagacaaagauaaacgaaaucaaugcagauauuguagauuaaaaaaauguuucagagcaggaaugaaaaaagaagcuguccaaaaugaacgagaucgaauaagcacacgacgauccucauaugaagauucaucacuaccauccauaaacgcauuacuacaagcagaagucuuaucaagacaaauaacaucaccaguaucaggaaucaacggagauauaagagcaaaaaaaauugcaucaauagcagauguaugcgaaucaaugaaagaacaauuacuuguccuuguagaaugggccaaauacauaccagcauuuugugaacuaccacuagacgaucaaguagcauuauuaagagcacacgccggagaacacuuauuacucggagcaacaaaaagauccaugguauuuaaagacguacuuuuacuaggcaaugauuacauaguaccucgucacuguccagaacuagcagaaaugucacgaguaucaauaagaauccuagaugaacuuguacuaccauuccaagaauuacaaauagacgacaacgaauacgcauaccucaaagcuauaauauucuuugacccagacgcaaaaggcuuaucugauccaggaaaaaucaaaagauuaagaucacaaguacaaguaucauuagaagacuacauaaacgauagacaauacgauucaagaggcagauuuggagaacuauuauuacuacuacccacacuacaaucuauaacauggcaaaugauugagcaaauacaguuuauaaaacuauucggaauggcaaaaauagacaaccuauuacaagaaaugcuacuaggaggcucaccaagugaugccccccacgcacaccauccacuccacccacaccucaugcaagaacacaugggaacaaauguuauaguagcaaacacuaugccaacccacuuaucuaauggacaaaugugcgaauggccaagaccacguggucaagcagcgacaccugaaacaccacaaccaaguccaccaggcgguucaggaucagaacccuauaaauuauuacccggagccguagcaacaauaguaaaaccacuaucugcuauaccacaaccaacaauaacaaaacaagaaguaauauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2378 - RNA, 906 nt, Artificial Sequence
  mRNA product Design4 comprising derived and/or modified sequence from Homo sapiens__NP_061986.1__HsFGF21 (opt12)
gggagagucccgcagucggcguccagcggcucugcuuguucgugugugugucguugcaggccuuauucaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2379 - RNA, 1632 nt, Artificial Sequence
  mRNA product Design4 comprising derived and/or modified sequence from Homo sapiens__NP_078852.3__HsOGFRL1 (opt12)
gggagagucccgcagucggcguccagcggcucugcuuguucgugugugugucguugcaggccuuauucaagcuuaccaugggaaacuuauuaggaggaguaucauuccgagaaccuacgaccguugaagacugcgacucaacauggcaaacagacucugaaccagaaccagaagaaccuggaccaggcggaggaagcgaaggcccaggacaagaauccgaacaaccagcacaaccaccagaacaagcaggaggaagaccuggagcaucgcccgccccagaugaagacgcagaagccgcaggagcagaacaaggaggcgacuccacagaagccacagcaaaaccaaaacgaucauucuacgcugcacgcgaucuauacaaauauagacaccaauauccaaacuucaaagauauaagauaccaaaaugacuuaagcaacuuacgguucuacaaaaacaaaaucccauuuaaaccagacggaguauacauagaagaaguacuaucaaaauggaaaggagacuacgaaaaacuagaacacaaccacacauacauacaaugguuauucccuuuaagagaacaaggacucaauuucuaugcaaaagaacuaaccacauacgaaauugaagaauuuaaaaaaacaaaagaagcaaucagaagauucuuacuagcauacaaaaugaugcuagaauuuuuuggaauaaaacucacagacaaaacaggaaacguagccagagcaguuaacuggcaagaacgcuuucaacaucuaaacgaaucacaacacaacuaucucagaauaacaagaauacuaaaaucacugggagaauuaggcuacgaaucauuuaaaucaccacuuguaaaauucauauuacacgaagcacucguagaaaacacaauaccaaauauaaaacaaucugcccucgaauauuuugucuacaccaucagagauagacgcgaaagaagaaaauuauuacgauucgcacaaaaacauuacacaccaucagaaaacuucauauggggaccaccaagaaaagaacaauccgaaggaaguaaagcacaaaaaaugucaucaccacuagcauccucacacaacagucaaacaagcaugcacaaaaaagcaaaagacagcaaaaacucaucaagugcaguacaccuaaacucaaaaacagcagaagauaaaaaaguagcuccuaaagaaccgguugaagaaacagaucgaccaucaccagaaccaagcaacgaagcagcaaaaccuagaaacacagaaaaagacucaaaugcagaaaacaugaauagccaaccugaaaaaacaguaaccacaccaacagaaaaaaaagaaaguguaaguccagaaaacaaugaagaaggagguaacgacaaucaagauaacgaaaacccaggcaauaccaacugucaugacguaguucuaguacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2380 - RNA, 834 nt, Artificial Sequence
  mRNA product Design4 comprising derived and/or modified sequence from Homo sapiens__NP_008842.1__HsRLN1 (opt12)
gggagagucccgcagucggcguccagcggcucugcuuguucgugugugugucguugcaggccuuauucaagcuuaccaugccaagacuauucuuauuccacuuacuagaauuuugccuacuacuaaaccaauucucaagagcagucgcagcaaaauggaaagacgacguaauaaaacuaugcggaagagaacuuguaagagcacaaauagcaauaugcggaauguccacauggucaaaaagaucacuaucacaagaagacgcaccacaaacaccaagaccaguagcagaaauaguaccuagcuucauaaacaaagacacagaaacaauaauaauaauguuagaauuuauagccaaccuaccacccgaacuaaaagcagcauuaagcgaaagacaaccaucauuaccagaauuacaacaauacguaccagcacuaaaagacucaaaccuaucauucgaagaauuuaaaaaauuaauaagaaacagacaaucagaagcagcagauucaaacccaucagaacuaaaauaccuaggacuagacacacacucacaaaaaaaaagaagaccauacguagcacuauucgaaaaaugcugccuaauaggaugcacaaaacgaucauuagcaaaauacugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2381 - RNA, 834 nt, Artificial Sequence
  mRNA product Design4 comprising derived and/or modified sequence from Homo sapiens__NP_604390.1__HsRLN2 (opt12)
gggagagucccgcagucggcguccagcggcucugcuuguucgugugugugucguugcaggccuuauucaagcuuaccaugccaagacuauucuucuuccacuuacuaggaguaugcuuacuacuaaaccaauucucaagagcaguagcagacucauggauggaagaaguaauaaaacuaugcggcagagaacuuguaagagcacaaauagcaauaugcggaaugucaaccuggucaaaaagaucacuaucacaagaagacgcaccacaaacaccacgaccaguagcagaaauaguaccaucauucauaaacaaagacacagaaacaauaaacaugaugucagaauuuguagcaaacuuaccccaagaacuaaaauuaacauuaucagaaaugcaaccagcacuaccacaacuacaacaacacguaccaguacuaaaagacucaucacuacuauucgaagaauuuaaaaaacuaauaagaaacagacaaucagaagcagcagacucaucaccaucagaauuaaaauaccuaggacuagacacacacagcagaaaaaaacgacaacuauacagcgcacuagcaaacaaaugcugccacguaggaugcacaaaaagaucacuagcaagauucugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2382 - RNA, 705 nt, Artificial Sequence
  mRNA product Design4 comprising derived and/or modified sequence from Homo sapiens__NP_543140.1__HsRLN3  (opt12)
gggagagucccgcagucggcguccagcggcucugcuuguucgugugugugucguugcaggccuuauucaagcuuaccauggcaagguauauguuauuauuauuacuagcaguauggguauuaacaggagaauuauggccaggagcagaagcaagagcagcaccauauggagugagauuauguggaagagaauuuauaagagcaguaauauuuacauguggaggaaguagauggagaagaagugauauauuagcacaugaagcaaugggagauacauuuccagaugcagaugcagaugaagauucauuagcaggagaauuagaugaagcaaugggaaguagugaaugguuagcauuaacaaaaagcccacaagcauuuuauagaggaagaccaaguuggcaaggaacaccaggaguauuaagaggaaguagagauguauuagcaggauuaaguaguaguuguuguaaauggggauguaguaaaagugaaauaaguaguuuauguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2383 - RNA, 1686 nt, Artificial Sequence
  mRNA product Design4 comprising derived and/or modified sequence from Homo sapiens__NP_002412.1__HsMMP1 (opt12)
gggagagucccgcagucggcguccagcggcucugcuuguucgugugugugucguugcaggccuuauucaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2384 - RNA, 1446 nt, Artificial Sequence
  mRNA product Design4 comprising derived and/or modified sequence from Homo sapiens__NP_002412.1__HsMMP1(1-19,100-469) (opt12)
gggagagucccgcagucggcguccagcggcucugcuuguucgugugugugucguugcaggccuuauucaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2385 - RNA, 3633 nt, Artificial Sequence
  mRNA product Design4 comprising derived and/or modified sequence from Clostridium histolyticum__BAA77453.1__ColG (opt12)
gggagagucccgcagucggcguccagcggcucugcuuguucgugugugugucguugcaggccuuauucaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2386 - RNA, 3357 nt, Artificial Sequence
  mRNA product Design4 comprising derived and/or modified sequence from Clostridium histolyticum__BAA77453.1__HsALB(1-18)_ColG(111-1118) (opt12)
gggagagucccgcagucggcguccagcggcucugcuuguucgugugugugucguugcaggccuuauucaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2387 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt12)
gggagagucccgcagucggcguccagcggcucugcuuguucgugugugugucguugcaggccuuauucaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2388 - RNA, 3381 nt, Artificial Sequence
  mRNA product Design4 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2389 - RNA, 3342 nt, Artificial Sequence
  mRNA product Design4 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2390 - RNA, 3276 nt, Artificial Sequence
  mRNA product Design4 comprising derived and/or modified sequence from Clostridium histolyticum__BAA34542.1__HsALB(1-18)_ColH(41-1021) (opt12)
gggagagucccgcagucggcguccagcggcucugcuuguucgugugugugucguugcaggccuuauucaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2391 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt12)
gggagagucccgcagucggcguccagcggcucugcuuguucgugugugugucguugcaggccuuauucaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2392 - RNA, 1122 nt, Artificial Sequence
  mRNA product Design4 comprising derived and/or modified sequence from Homo sapiens__NP_003801.1__HsTNFSF10 (opt13)
gggagagucccgcagucggcguccagcggcucugcuuguucgugugugugucguugcaggccuuauucaagcuuaccauggcaaugauggaaguccaaggaggacccucacuaggacaaacaugcguacuaauaguaauauucacaguacuacuacaaucacuaugcguagcaguaacauacgucuacuuuacaaacgaacuuaaacaaaugcaagauaaauacucaaaaucaggaauagcaugcuucuuaaaagaagaugacucauacugggacccaaacgacgaagaaucaaugaauagcccaugcuggcaaguaaaauggcaacuaagacaacuuguaagaaaaaugauacuaagaacaucagaagaaacaauaucaacaguacaagaaaaacaacaaaacauaucaccauuaguaagagaaagaggcccacaacgcguagcagcacacauaacaggaacaagaggaagaucaaacacacuaucaucaccaaauucaaaaaaugaaaaagcauuaggacgaaaaaucaacucaugggaaucaucaagaucaggacauucauucuuaaguaaucuacacuuacgaaacggagaauuaguaauacacgaaaaaggauucuacuacauauacucacaaacauacuucagauuccaagaagaaauaaaagaaaacacaaaaaacgacaaacaaaugguacaauacauauauaaauauacaagcuacccagacccaauauuauuaaugaaaagugcaagaaauagcugcuggucaaaagacgcagaauauggacuauacucaauauaccaaggaggaauauucgaacuaaaagaaaacgaccgaauauucguaucaguaacaaacgaacaccuaauagacauggaccacgaagcaucauucuucggagcauuccucgucggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2393 - RNA, 843 nt, Artificial Sequence
  mRNA product Design4 comprising derived and/or modified sequence from Homo sapiens__NP_003801.1__HsTNFSF10(95-281) (opt13)
gggagagucccgcagucggcguccagcggcucugcuuguucgugugugugucguugcaggccuuauucaagcuuaccaugacaucagaagaaacaauaucaacaguacaagaaaaacaacaaaacauaucaccccuaguaagagaaagaggaccacaacgaguagcagcacacauaacaggaacaagaggacgaucaaacacacuaucaucaccaaacuccaaaaacgaaaaagcacuaggaagaaaaauaaacucaugggaaucaucaagaagcggacacucauuucuaucaaaccuacaccuaagaaacggagaauuaguaauacacgaaaaaggauucuacuacauauacucacaaacauacuucagauuccaagaagaaauaaaagaaaacaccaaaaacgacaaacaaaugguacaauacauauacaaauacacaucuuacccagacccaauacuacuaaugaaaucagcaagaaacagcugcuggucaaaagacgcagaauacggacuauacucaauauaccaagguggaauauucgaacuaaaagaaaacgacagaauauucguaucaguaacaaacgaacacuuaauagacauggaccacgaagcaucauucuucggagcauucuuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2394 - RNA, 894 nt, Artificial Sequence
  mRNA product Design4 comprising derived and/or modified sequence from Homo sapiens__NP_003801.1__HsALB(1-18)_HsTNFSF10(95-281) (opt13)
gggagagucccgcagucggcguccagcggcucugcuuguucgugugugugucguugcaggccuuauucaagcuuaccaugaaauggguaacauucauaucacuacuauuccuauucucaucagcauacucaacaucagaagaaacaauaagcacaguacaagaaaaacaacaaaacauaucaccacucguaagagaaagaggaccacaaagaguagcagcacacauaacaggaacaagaggacgaucaaacacacuaucaucaccaaacagcaaaaacgaaaaagcacuaggaagaaaaaucaauucaugggaauccucaagaucaggacacucauuccuauccaaccuacaccuaagaaacggagaauuagucauacacgaaaaaggauucuacuacauauacucacaaacauacuucagauuccaagaagaaauaaaagaaaacaccaaaaacgacaaacaaaugguacaauacauauacaaauacacaucauacccagacccaauacuacuaaugaaaucagcaagaaacaguugcuggucaaaagacgcagaauacggacuauacucaauauaccaaggaggaauauucgaacuaaaagaaaacgacagaauauucguaucaguaacaaacgaacaccuaauagauauggaccacgaagcaucauucuucggagccuuccuaguaggauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2395 - RNA, 990 nt, Artificial Sequence
  mRNA product Design4 comprising derived and/or modified sequence from Homo sapiens__NP_003801.1__HsALB(1-18)_ILZ_HsTNFSF10(95-281) (opt13)
gggagagucccgcagucggcguccagcggcucugcuuguucgugugugugucguugcaggccuuauucaagcuuaccaugaaauggguaacauuuauaucacuauuauuccuauucucaagcgcauacucaagaaugaaacaaauagaagacaaaauagaagaaauacuaucaaaaauauaccacauagaaaacgaaauagcacgaauaaaaaaacuaauaggagaaacaucagaagaaaccauaagcacaguacaagaaaaacaacaaaacauaagcccacuuguaagagaaagaggaccacaaagaguagcagcacacauaacaggaacaagaggaagauccaacacauuaucauccccaaacucaaaaaacgaaaaagcacuaggacgaaaaauaaacagcugggaaucaagcagaucaggacacucauuccuaagcaaccuacaccuaagaaacggagaauuaguaauacacgaaaaaggauucuacuacauauacucccaaacauacuuccgauuccaagaagaaauaaaagaaaacacaaaaaacgacaaacaaaugguacaauacauauacaaauacaccucauacccagacccaauacuacuaaugaaaagcgcaagaaacucaugcuggucaaaagacgcagaauacggacuauacucaauauaccaaggaggaauauucgaauuaaaagaaaacgaucgaauauucguaagcguaacaaacgaacaccuaauagacauggaccaugaagcaucauucuucggagcauuccucguaggcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2396 - RNA, 1353 nt, Artificial Sequence
  mRNA product Design4 comprising derived and/or modified sequence from Rattus norvegicus__NP_036656.1__RnCebpa (opt13)
gggagagucccgcagucggcguccagcggcucugcuuguucgugugugugucguugcaggccuuauucaagcuuaccauggaaagugcggauuuuuacgaagcagaaccaagaccaccaauguccucucaucuucaaucaccaccucaugcuccaucaaaugcugcauuugguuuuccaagaggagcuggaccagcaccuccaccagcaccucccgcagcaccagaacccuuaggagguauaugcgaacaugaaacaucaauagauauaucagcauacauagauccugcagcauucaaugaugaauuuuuagcagauuuauuucaacauucaagacaacaagaaaaagcuaaagcagcugcaggaccagcagguggaggaggagauuuugacuauccaggugcaccagcaggccccggaggcgcaguaaugagcgccggagcccauggaccaccaccaggauacgguugugcugcagcaggcuauuuagacggaagacuagaaccauuauaugaacgaguaggagcuccagcauuaagaccauuaguaauuaaacaagaaccaagagaagaagaugaagcaaaacaacuagcauuagcaggacuauuuccauaucaaccacccccaccuccaccaccaccacacccacacgcauccccagcacacuuagcagcaccacauuuacaauuucaaauagcacauuguggacaaacaacuaugcauuuacaaccaggacauccaacaccaccaccaacaccuguuccuucaccacacccagcaccagcaaugggagcagcaggauuaccaggaccaggaggaucauuaaaaggauuagcuggaccacauccagaucucagaacaggaggaggaggaggaggaggagcaggagcuggaaaagcaaaaaaaucaguagauaaaaacucaaaugaauauagaguaagaagggaaagaaauaacauagcaguaagaaaaaguagagauaaagcaaaacaaagaaauguagaaacacaacaaaaaguauuagaauuaaccucagauaaugaucgauuaagaaaaagaguagaacaauuaucaagagaauuagauacauuaagagguauuuuuagacaauuaccagaaucuucacuaguaaaagcaaugggaaacugcgcuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2397 - RNA, 1311 nt, Artificial Sequence
  mRNA product Design4 comprising derived and/or modified sequence from Rattus norvegicus__NP_036656.1__RnCebpa(15-344) (opt13)
gggagagucccgcagucggcguccagcggcucugcuuguucgugugugugucguugcaggccuuauucaagcuuaccaugucaagccaucuacaaaguccaccacaugcaccaucaaaugccgcauuuggguuuccaagaggagcaggaccagcaccaccaccagcaccaccagccgcuccagaaccauuaggaggaauaugugagcaugaaacaucaauagauauaucagcauauauagauccagcagcauuuaaugaugaauuucuugcagauuuauuucaacauucacgacaacaagaaaaagccaaagcagcagcaggaccagcaggaggaggcggagauuuugauuauccuggagcaccagcaggaccaggaggcgcaguaauguccgcaggagcacacggaccaccaccaggauauggaugugcagcugcaggauauuuagauggacgucuugaaccauuauaugaacgagucggagcuccagcacuaagaccacuaguaauaaaacaagaaccaagagaagaagaugaagcuaaacaacuugcacuagcaggacuauucccauaucaaccaccaccuccaccaccaccaccacacccacaugcaaguccagcccauuuagcagcaccacauuuacaauuucaaauagcccacuguggacaaacaacuaugcauuuacaaccaggacauccuacaccaccaccgacaccuguaccaucaccucauccugcaccagcuaugggagcagcaggauuaccaggaccaggaggaucacuaaaaggauuagcaggaccucauccagaucuaagaacaggagguggagggggaggaggagcaggagcagggaaagcaaaaaaaucaguagauaaaaacucaaaugaauauagaguaagaagagaaagaaauaauauagcaguaagaaaaaguagagauaaagcaaaacaacgaaauguagaaacacaacaaaaaguacuagaauuaacaagcgauaaugacagauuaagaaaaagaguagaacaauuaucaagagaauuagauacacuacgaggaaucuuuagacaacuaccagaaaguaguuuaguuaaagcuaugggaaauugugcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2398 - RNA, 1356 nt, Artificial Sequence
  mRNA product Design4 comprising derived and/or modified sequence from Mus musculus__NP_031704.2 __MmCebpa (opt13)
gggagagucccgcagucggcguccagcggcucugcuuguucgugugugugucguugcaggccuuauucaagcuuaccauggaaucagcagauuuuuaugaaguugaaccuagaccaccaaugagcucacaucuacaaucaccaccacacgcaccuucuaacgcugcauuuggauuuccacgaggagcaggccccgcaccuccaccagcaccaccagcugcaccagaaccucuuggaggaauaugcgaacacgaaacaaguauagauaucucagcauauauagacccagcagcauucaaugaugaauuuuuagcagacuuauuucaacauucaagacaacaagaaaaagcaaaagcagcagcaggaccagcaggaggaggaggagacuucgauuauccuggagcucccgcagguccuggcggagcaguaaugucagccggagcacauggaccaccuccaggauauggaugugcagcagcuggauauuuagacggaagguuagaaccacuauaugaaagaguaggagcaccagcauuacgaccacuaguuauaaaacaagaaccuagagaagaagacgaagcaaaacaacuagcacuagcagguuuauuuccauaccaaccuccaccaccucccccaccaccucacccacaugcaucaccagcacacuuagcggcaccacauuuacaauuucaaauagcacauuguggacaaacaacaaugcauuuacaaccuggacauccaacaccaccaccaacaccgguaccaucaccucaugcagcaccagcacucggagcagcaggucuaccaggaccaggaucagcuuuaaaaggauuagcaggagcacauccagauuuaagaacagguggagguggaggaggaaguggugcaggagcaggcaaagcaaaaaaaucagucgauaaaaacuccaacgaauacagaguaagaagagaaagaaacaauauagcagugagaaaaaguagagacaaagcaaaacaacgaaauguagaaacacaacaaaaaguauuagaguuaacaucagauaaugaucgauuaagaaaaagaguugaacaauuaucaagagaacuagauacacuaagaggaauauuuagacaauuaccagaaucaucauuaguaaaagcaaugggaaacugcgcauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2399 - RNA, 1314 nt, Artificial Sequence
  mRNA product Design4 comprising derived and/or modified sequence from Mus musculus__NP_031704.2 __MmCebpa(15-359) (opt13)
gggagagucccgcagucggcguccagcggcucugcuuguucgugugugugucguugcaggccuuauucaagcuuaccaugagcagucaucuacaaucaccaccacaugcaccuucaaaugcagcauuuggauuuccacgaggagcagguccagcacccccaccagcaccaccagcagcaccugaaccucuagguggaaucugugaacaugaaacaaguauagauaucucagcauauauagauccagcagcauuuaaugaugaauuuuuagcugaucuuuuucaacacucaaggcaacaagaaaaagcaaaagcagcagccggaccagcaggaggaggaggagauuuugauuaucccggagcaccagcaggaccaggcggagcaguaaugucagcuggugcacaugguccgccaccuggauaugggugugcagcagcaggauauuuagauggaagauuagaaccacuauaugaaagagucggugcaccagcauuaagaccccuaguaauaaaacaagaaccaagagaagaagacgaagcaaaacaacuagcauuagcaggccuauuuccauaucaaccaccaccaccaccacccccaccacauccacaugcaucaccagcacaucuagcagcuccacauuuacaauuccaaauagcucauuguggacaaacaacaaugcaucuacaaccuggacacccaacaccaccaccaacuccaguaccaucaccacacgcagcaccagcacuaggagcagcaggccuaccaggaccaggaagugcuuuaaaaggauuagcuggugcacauccagauuuaagaacaggagguggcggaggaggaaguggugcaggagcaggcaaagcaaagaaaagcguagauaaaaauucuaaugaauauagaguaagaagagaaaggaauaauauagcaguacgaaaaucuagagauaaagcaaaacaacgaaauguagaaacacaacaaaaaguucuagaauuaacaucagauaacgauagacuaagaaaaagagucgaacaauuaucaagggaauuagacacauuaagaggcauauucagacaacuuccagaaucaucauuagucaaagcaaugggaaauugugcaugaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2400 - RNA, 1353 nt, Artificial Sequence
  mRNA product Design4 comprising derived and/or modified sequence from Homo sapiens__NP_004355.2__HsCEBPA (opt13)
gggagagucccgcagucggcguccagcggcucugcuuguucgugugugugucguugcaggccuuauucaagcuuaccauggaaucugcagauuuuuaugaagcagaaccaagaccaccuauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2401 - RNA, 1311 nt, Artificial Sequence
  mRNA product Design4 comprising derived and/or modified sequence from Homo sapiens__NP_004355.2__HsCEBPA(15-358) (opt13)
gggagagucccgcagucggcguccagcggcucugcuuguucgugugugugucguugcaggccuuauucaagcuuaccauguccagccaucuccaaucacccccacaugcaccaaguucagccgcauuuggauuuccacgcggagcaggaccagcacaaccaccagcaccuccugcagcuccugaaccuuuaggaggaauaugugaacaugaaacaaguauagacauaagcgcauacauagacccagccgcauucaaugacgaauuuuuagcagaucuauuucaacauucaagacaacaagaaaaagcuaaagcugcaguuggaccuacaggugguggaggaggcggagauuuugauuauccuggagcuccagcaggaccuggaggcgcagucaugccaggaggugcacauggaccuccaccagguuacgguugugcagcagcaggauaucuagauggcagacuagaaccacuauacgaaagaguaggagcaccagcccuacgaccauuaguaauaaaacaagaaccaagagaagaagaugaagcaaaacaacuagcauuagcaggauuauuuccauaucaaccaccaccuccaccaccaccaucacauccacauccacauccaccaccagcucauuuagcagcaccucacuuacaauuucaaauagcacauuguggacaaaccacaaugcauuuacaaccaggacauccaacuccaccuccaacaccuguacccuccccacauccagcuccugcacuaggagcagcaggauuaccagguccaggaucagcauuaaaagguuuaggagcagcacacccagaucuaagagcaagcggcggaucaggagcaggaaaagcaaaaaaaucuguagacaaaaauucaaacgaauauagaguaagaagagaaagaaauaauauagccguaagaaaaagcagagauaaagcaaaacaaagaaauguugaaacccaacaaaaaguauuagaauuaaccagugacaaugacagacuuagaaaaagaguagaacaacucucaagagaauuagacacauuacgaggaauauuccgccagcuaccagaaucaucauuaguaaaagcaaugggaaacugcgcuuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2402 - RNA, 1701 nt, Artificial Sequence
  mRNA product Design4 comprising derived and/or modified sequence from Homo sapiens__NP_000448.3__HsHNF4A (opt13)
gggagagucccgcagucggcguccagcggcucugcuuguucgugugugugucguugcaggccuuauucaagcuuaccaugagacuaaguaaaacauuaguagacauggacauggccgacuauagugccgcauuagauccagcuuauacaacacuagaauuugaaaacguccaaguauuaacaaugggaaaugacacaucaccaagugaaggcaccaaucuaaaugcaccaaacucacuagguguaucagcccucugcgcaauaugcggagacagagcaacagggaaacacuacggagcaucuucaugugacggauguaaaggcuucuuuagaagaucaguaagaaaaaaccacauguacaguugcagauucagcagacaauguguagucgacaaagauaaaagaaaucaaugcagauauugcagacuaaaaaaauguuuccgagcaggaaugaaaaaagaagcaguacaaaacgaaagagaucguaucucaacaagaagaucaucauacgaagacucaagucuaccaagcauaaacgcacuucuucaagcagaaguacuaagcagacaaauaacaagcccgguaucagguaucaacggagacauaagggcaaaaaaaauagcgucaauagcagacguaugcgaaaguaugaaagaacaauuacuuguccuuguagaaugggcaaaauacauaccugcauuuugcgaauuaccacuagacgaccaaguagcacuauuaagagcacaugcaggagaacaccuucuacuaggagcuacuaaaagaucaaugguauuuaaagacguacuauuacuaggaaaugauuacauaguaccaagacacugcccagaacuugcagaaaugucacgaguaagcauaagaauccuagaugaacuugucuuaccauuccaagaauuacaaauagacgacaacgaauacgcauaucuaaaagcaauaauauuuuucgacccagacgcaaaaggacuaucagauccaggcaaaauuaaacgacuccgaucacaaguucaaguaucucuagaagacuauauaaacgaucgacaauacgauagucgaggacgauucggugaauuauuacuucuuuuaccaacauuacaaucaauaacguggcaaaugauugaacaaauccaauucauaaaauuauucggaauggcaaaaauagacaaucuauuacaagaaaugcuacuuggaggaagcccaucagacgcuccacacgcccaccacccucuacauccacaccuaaugcaagaacacaugggcacuaacguaauaguagcaaacacaaugcccacccaucuaucaaacggacaaaugugcgaauggccaagacccagaggacaagcugcaacaccagaaacaccacaaccaaguccaccaggagguaguggaagugaaccauacaaacuuuuaccaggagcaguagcaacaauaguaaaaccacuaucagcaauuccccaaccaacaauaacaaaacaagaaguaauauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2403 - RNA, 906 nt, Artificial Sequence
  mRNA product Design4 comprising derived and/or modified sequence from Homo sapiens__NP_061986.1__HsFGF21 (opt13)
gggagagucccgcagucggcguccagcggcucugcuuguucgugugugugucguugcaggccuuauucaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2404 - RNA, 1632 nt, Artificial Sequence
  mRNA product Design4 comprising derived and/or modified sequence from Homo sapiens__NP_078852.3__HsOGFRL1 (opt13)
gggagagucccgcagucggcguccagcggcucugcuuguucgugugugugucguugcaggccuuauucaagcuuaccaugggaaaccuacucggcggaguuucauucagagaaccaacaacaguagaagacugcgauaguacauggcagaccgauucagaaccugaaccagaagaaccaggccccgguggaggaagcgaaggcccuggacaagaaucagaacaaccagcacaaccaccagaacaagcaggaggaagaccaggagcaagcccagcaccagacgaagacgcagaagcagcaggagccgaacaaggaggagauagcacugaagcaacagcaaaaccaaaaagaucuuuuuacgcagcacgagacuuauauaaauauagacaccaauacccaaauuucaaagacauaagauaccaaaaugaccuauccaaccuacgcuucuacaaaaauaaaauuccauucaaaccagauggaguauacauagaagaaguacuaagcaaauggaaaggugacuaugaaaaacuagaacauaaccacaccuacauacaauggcuauuuccccuaagagaacaaggauuaaauuucuacgcaaaagaacuuacaaccuacgaaauagaagaauuuaaaaaaaccaaagaagccauaagaagauucuuauuagcauacaagaugauguuagaauuuuucggaauuaaacucacagacaaaacaggcaacguagcacgagccguaaacuggcaagaacgauuccaacacuuaaacgaaagucagcacaacuaccuaagaauaacaagaauauuaaaaaguuuaggagaacuaggcuacgaaucauucaaaucuccacuuguaaaauucauacuacacgaagccuuagucgaaaacacaauaccaaacauaaaacaaucugcacuagaauacuuuguauacacaauaagagacagaagagaaaggagaaaauuacuacgauucgcucaaaaacacuauacaccaucagaaaauuucauauggggccccccaagaaaagaacaaagcgaaggcucaaaagcacaaaaaaugucaaguccacuagcaucaagccauaacucacaaacuucaaugcacaaaaaagccaaagacucaaagaacucaucaucagccguacaccuaaacagcaaaacagcagaagauaaaaaaguugcaccaaaagaaccaguagaagaaacagauagaccaucaccagaaccaucaaacgaagcggcaaaaccaagaaacacugagaaagauagcaacgcagaaaacaugaacagccaaccagaaaaaacaguaacgacaccaacugaaaaaaaagaaucaguaaguccagaaaauaaugaagaaggcggcaacgauaaccaagacaacgaaaauccaggaaauaccaacugccacgacguaguauuaguacaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2405 - RNA, 834 nt, Artificial Sequence
  mRNA product Design4 comprising derived and/or modified sequence from Homo sapiens__NP_008842.1__HsRLN1 (opt13)
gggagagucccgcagucggcguccagcggcucugcuuguucgugugugugucguugcaggccuuauucaagcuuaccaugccaagacuauucuuauuccaccuacuagaauuuugcuuacuacuaaaccaauucucaagagcaguagcagcaaaauggaaagacgacguaauaaaacuaugcggaagagaacuuguaagagcacaaauagcaauaugcggaaugucaacauggucaaaaagaucacuaucacaagaagacgccccacaaacaccaagaccaguagcagaaauaguaccaucauucauaaacaaagacacagaaacaauaauaauaaugcuagaauuuauagcaaaccuaccaccagaauuaaaagcagcauuaucagaaagacaaccaucauuaccagaacuacaacaauacguaccagcacuaaaagacucaaaccuaucauucgaagaauuuaaaaaacuaauaagaaacagacaaucagaagcagcagacucaaacccaucagaacuaaaauaccuaggacuagacacacacucacaaaaaaaacgaagaccauacguagcacuauuugaaaaaugcugcuuaauaggaugcacaaaaagaucacuagcaaaauacugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2406 - RNA, 834 nt, Artificial Sequence
  mRNA product Design4 comprising derived and/or modified sequence from Homo sapiens__NP_604390.1__HsRLN2 (opt13)
gggagagucccgcagucggcguccagcggcucugcuuguucgugugugugucguugcaggccuuauucaagcuuaccaugccaagacuauucuuuuuccaccuacuaggcguaugccuccuacuaaaccaauuuucaagagcaguagcagacucauggauggaagaaguaauaaaacuaugcggaagagaacuuguaagagcacaaauagcaauaugcggaaugucaacauggucaaaaagaucauuaucacaagaagacgcaccacaaacaccaagaccaguagcagaaauaguaccaucauucauaaacaaagacacagaaacaaucaauaugaugucagaauuuguagcaaaccucccacaagaacuaaaacuaacacuaucagaaaugcaaccagcacuaccacaauuacaacaacacgucccaguacucaaagacucaucacuauuauucgaagaauuuaaaaaauuaauaagaaacagacaaucagaagcagcagacagcucacccucagaacuaaaauaccuaggacuagacacacacucaagaaaaaaaagacaacuauacucagcacuagccaacaaaugcugccacguaggaugcacaaaaagaucacuagcaagauucugcuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2407 - RNA, 705 nt, Artificial Sequence
  mRNA product Design4 comprising derived and/or modified sequence from Homo sapiens__NP_543140.1__HsRLN3  (opt13)
gggagagucccgcagucggcguccagcggcucugcuuguucgugugugugucguugcaggccuuauucaagcuuaccauggcaagauauauguuauuauuauuauuagcaguauggguauuaacaggagaauuauggccaggagcagaagcaagagcagcaccauauggaguaagauuauguggaagagaauuuauaagagcaguaauauuuacauguggaggaaguagauggagaagaagugauauauuagcacaugaagcaaugggagauacauuuccagaugcagaugcagaugaagauaguuuagcaggagaauuagaugaagcaaugggaaguagugaaugguuagcauuaacaaaaaguccacaagcauuuuauagaggaagaccaaguuggcaaggaacaccaggaguauuaagaggaaguagagauguauuagcaggauuaaguucaaguuguuguaaauggggauguucaaaaucagaaauaaguucauuauguuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2408 - RNA, 1686 nt, Artificial Sequence
  mRNA product Design4 comprising derived and/or modified sequence from Homo sapiens__NP_002412.1__HsMMP1 (opt13)
gggagagucccgcagucggcguccagcggcucugcuuguucgugugugugucguugcaggccuuauucaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2409 - RNA, 1446 nt, Artificial Sequence
  mRNA product Design4 comprising derived and/or modified sequence from Homo sapiens__NP_002412.1__HsMMP1(1-19,100-469) (opt13)
gggagagucccgcagucggcguccagcggcucugcuuguucgugugugugucguugcaggccuuauucaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2410 - RNA, 3633 nt, Artificial Sequence
  mRNA product Design4 comprising derived and/or modified sequence from Clostridium histolyticum__BAA77453.1__ColG (opt13)
gggagagucccgcagucggcguccagcggcucugcuuguucgugugugugucguugcaggccuuauucaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2411 - RNA, 3357 nt, Artificial Sequence
  mRNA product Design4 comprising derived and/or modified sequence from Clostridium histolyticum__BAA77453.1__HsALB(1-18)_ColG(111-1118) (opt13)
gggagagucccgcagucggcguccagcggcucugcuuguucgugugugugucguugcaggccuuauucaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2412 - RNA, 3705 nt, Artificial Sequence
  mRNA product Design4 comprising derived and/or modified sequence from Clostridium histolyticum__BAA77453.1__HsALB(1-18)_ColG(1-110)_CS-F_ColG(111-1 118) (opt13)
gggagagucccgcagucggcguccagcggcucugcuuguucgugugugugucguugcaggccuuauucaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2413 - RNA, 3381 nt, Artificial Sequence
  mRNA product Design4 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2414 - RNA, 3342 nt, Artificial Sequence
  mRNA product Design4 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2415 - RNA, 3276 nt, Artificial Sequence
  mRNA product Design4 comprising derived and/or modified sequence from Clostridium histolyticum__BAA34542.1__HsALB(1-18)_ColH(41-1021) (opt13)
gggagagucccgcagucggcguccagcggcucugcuuguucgugugugugucguugcaggccuuauucaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2416 - RNA, 3414 nt, Artificial Sequence
  mRNA product Design4 comprising derived and/or modified sequence from Clostridium histolyticum__BAA34542.1__HsALB(1-18)_ColH(1-40)_CS-F_ColH(41-102 1) (opt13)
gggagagucccgcagucggcguccagcggcucugcuuguucgugugugugucguugcaggccuuauucaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuagucccuguucccagagcccacuuuuuuuucuuuuuuugaaauaaaauagccugucuuucagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
